United States Patent
Cotta-Ramusino

(10) Patent No.: US 11,680,268 B2
(45) Date of Patent: Jun. 20, 2023

(54) METHODS FOR IMPROVING CRISPR/CAS-MEDIATED GENOME-EDITING

(71) Applicant: Editas Medicine, Inc., Cambridge, MA (US)

(72) Inventor: Cecilia Cotta-Ramusino, Cambridge, MA (US)

(73) Assignee: Editas Medicine, Inc., Cambridge, MA (US)

( * ) Notice: Subject to any disclaimer, the term of this patent is extended or adjusted under 35 U.S.C. 154(b) by 0 days.

(21) Appl. No.: 15/524,672

(22) PCT Filed: Nov. 9, 2015

(86) PCT No.: PCT/US2015/059782
§ 371 (c)(1),
(2) Date: May 5, 2017

(87) PCT Pub. No.: WO2016/073990
PCT Pub. Date: May 12, 2016

(65) Prior Publication Data
US 2018/0298392 A1    Oct. 18, 2018

Related U.S. Application Data

(60) Provisional application No. 62/232,683, filed on Sep. 25, 2015, provisional application No. 62/077,084, filed on Nov. 7, 2014.

(51) Int. Cl.
| | | |
|---|---|---|
| *C12N 15/64* | (2006.01) | |
| *C12N 15/10* | (2006.01) | |
| *C12N 9/12* | (2006.01) | |

(52) U.S. Cl.
CPC .......... *C12N 15/64* (2013.01); *C12N 9/1241* (2013.01); *C12N 15/102* (2013.01); *C12N 2310/122* (2013.01); *C12N 2310/20* (2017.05)

(58) Field of Classification Search
None
See application file for complete search history.

(56) References Cited

U.S. PATENT DOCUMENTS

| | | | |
|---|---|---|---|
| 8,546,553 B2 | 10/2013 | Terns et al. | |
| 8,697,359 B1 | 4/2014 | Zhang | |
| 8,771,945 B1 | 7/2014 | Zhang | |
| 8,795,965 B2 | 8/2014 | Zhang | |
| 8,865,406 B2 | 10/2014 | Zhang et al. | |
| 8,871,445 B2 | 10/2014 | Cong et al. | |
| 8,889,356 B2 | 11/2014 | Zhang | |
| 8,889,418 B2 | 11/2014 | Zhang et al. | |
| 8,895,308 B1 | 11/2014 | Zhang et al. | |
| 8,906,616 B2 | 12/2014 | Zhang et al. | |
| 8,932,814 B2 | 1/2015 | Cong et al. | |
| 8,945,839 B2 | 2/2015 | Zhang | |
| 8,993,233 B2 | 3/2015 | Zhang et al. | |
| 8,999,641 B2 | 4/2015 | Zhang et al. | |
| 9,023,649 B2 | 5/2015 | Mali et al. | |
| 9,074,199 B1 | 7/2015 | Chavez et al. | |
| 9,234,213 B2 | 1/2016 | Wu | |
| 9,260,723 B2 | 2/2016 | Mali et al. | |
| 9,260,752 B1 | 2/2016 | May et al. | |
| 9,267,135 B2 | 2/2016 | Church et al. | |
| 9,322,037 B2 | 4/2016 | Liu et al. | |
| 9,388,430 B2 | 7/2016 | Liu et al. | |
| 9,404,098 B2 | 8/2016 | Terns et al. | |
| 9,410,198 B2 | 8/2016 | May et al. | |
| 9,422,553 B2 | 8/2016 | Terns et al. | |
| 9,512,446 B1 | 12/2016 | Joung et al. | |
| 9,567,603 B2 | 2/2017 | Joung et al. | |
| 9,567,604 B2 | 2/2017 | Joung et al. | |
| 9,587,252 B2 | 3/2017 | Church et al. | |
| 9,637,739 B2 | 5/2017 | Siksnys et al. | |
| 9,663,782 B2 | 5/2017 | Yu et al. | |
| 9,688,971 B2 | 6/2017 | Doudna et al. | |
| 9,725,714 B2 | 8/2017 | May et al. | |
| 9,738,908 B2 | 8/2017 | Wu | |
| 9,752,132 B2 | 9/2017 | Joung et al. | |
| 9,790,490 B2 | 10/2017 | Zhang et al. | |
| 9,803,194 B2 | 10/2017 | May et al. | |
| 9,809,814 B1 | 11/2017 | May et al. | |
| 9,822,370 B2 | 11/2017 | Musunuru et al. | |
| 9,822,372 B2 | 11/2017 | Zhang et al. | |
| 9,840,713 B2 | 12/2017 | Zhang | |

(Continued)

FOREIGN PATENT DOCUMENTS

| | | |
|---|---|---|
| WO | WO-2001/90404 A1 | 11/2001 |
| WO | WO-2007/025097 A2 | 3/2007 |

(Continued)

OTHER PUBLICATIONS

US 10,077,445 B2, 09/2018, Doudna et al. (withdrawn)
Schild et al., "Overexpression of RAD51 suppresses recombination defects: a possible mechanism to reverse genomic instability" 38(4) Nucleic Acids Research 1061-1070 (Nov. 26, 2009).*
Li et al., "Optimization of Genome Engineering Approaches with the CRISPR/Cas9 System" e 105779 1-10 (Aug. 28, 2014).*
Fine et al., "A Comparison of Repair Pathway Choice between ZFNs, TALENs, and CRISPRs at Endogenous Loci via Simultaneous Measurement of NHEJ and HDR Using SMRT Sequencing" 22 SSupplement 1 Molecular Therapy (May 2014).*
Findlay et al., "Saturation editing of genomic regious by multiplex homology-directed repair" 513 Nature 120-123 + Methods/Figures (Aug. 20, 2014).*
Salah-Gohari et al., "Conservative homologous recombination preferentially repairs DNA double-stand breaks in the S phase of the cell cycle in human cells" 32(12) Nucleic Acids Research 3683-3688 (2004).*

(Continued)

*Primary Examiner* — Nancy J Leith
(74) *Attorney, Agent, or Firm* — McCarter & English, LLP; Maria Laccotripe Zacharakis; Marcie B. Clarke

(57) ABSTRACT

This application provides improved methods of editing the genome of a target cell. Cas9 molecules can be used to create a break in a genomic region of interest. To increase the likelihood that the break is repaired by homology-directed repair (HDR), the cell can be contacted with an HDR-enhancer. The cell may be, e.g., a human cell, a non-human animal cell, a bacterial cell, or a plant cell.

17 Claims, 10 Drawing Sheets
Specification includes a Sequence Listing.

(56) References Cited

U.S. PATENT DOCUMENTS

| | | |
|---|---|---|
| 9,873,894 B2 | 1/2018 | Conway et al. |
| 9,879,269 B2 | 1/2018 | Barrangou et al. |
| 9,885,026 B2 | 2/2018 | Brouns et al. |
| 9,902,974 B2 | 2/2018 | Conway et al. |
| 9,909,122 B2 | 3/2018 | May et al. |
| 9,926,545 B2 | 3/2018 | Joung et al. |
| 9,926,546 B2 | 3/2018 | Joung et al. |
| 9,944,912 B2 | 4/2018 | Joung et al. |
| 9,963,689 B2 | 5/2018 | Doudna et al. |
| 9,970,001 B2 | 5/2018 | Miller |
| 9,970,024 B2 | 5/2018 | Church et al. |
| 10,066,233 B2 | 9/2018 | Barrangou et al. |
| 10,077,453 B2 | 9/2018 | Liu et al. |
| 10,093,910 B2 | 10/2018 | Joung et al. |
| 10,100,291 B2 | 10/2018 | Chavez et al. |
| 10,113,167 B2 | 10/2018 | Doudna et al. |
| 10,113,179 B2 | 10/2018 | Begemann et al. |
| 2010/0076057 A1 | 3/2010 | Sontheimer et al. |
| 2010/0093617 A1 | 4/2010 | Barrangou et al. |
| 2013/0011828 A1 | 1/2013 | Barrangou et al. |
| 2014/0068797 A1 | 3/2014 | Doudna et al. |
| 2014/0093941 A1 | 4/2014 | Terns et al. |
| 2014/0179770 A1 | 6/2014 | Zhang et al. |
| 2014/0186843 A1 | 7/2014 | Zhang et al. |
| 2014/0186919 A1 | 7/2014 | Zhang et al. |
| 2014/0186958 A1 | 7/2014 | Zhang et al. |
| 2014/0189896 A1 | 7/2014 | Zhang et al. |
| 2014/0199767 A1 | 7/2014 | Barrangou et al. |
| 2014/0242664 A1 | 8/2014 | Zhang et al. |
| 2014/0242699 A1 | 8/2014 | Zhang |
| 2014/0242702 A1* | 8/2014 | Chen ................ A61P 43/00 435/468 |
| 2014/0256046 A1 | 9/2014 | Zhang et al. |
| 2014/0273037 A1 | 9/2014 | Wu |
| 2014/0273226 A1 | 9/2014 | Wu |
| 2014/0273230 A1 | 9/2014 | Chen et al. |
| 2014/0273233 A1 | 9/2014 | Chen et al. |
| 2014/0287938 A1 | 9/2014 | Zhang et al. |
| 2014/0294773 A1 | 10/2014 | Brouns et al. |
| 2014/0302563 A1 | 10/2014 | Doudna et al. |
| 2014/0310830 A1 | 10/2014 | Zhang et al. |
| 2014/0315985 A1 | 10/2014 | May et al. |
| 2014/0342456 A1 | 11/2014 | Mali et al. |
| 2014/0342457 A1 | 11/2014 | Mali et al. |
| 2014/0342458 A1 | 11/2014 | Mali et al. |
| 2014/0356956 A1 | 12/2014 | Church et al. |
| 2014/0357523 A1 | 12/2014 | Zeiner et al. |
| 2014/0357530 A1 | 12/2014 | Zhang et al. |
| 2014/0377868 A1 | 12/2014 | Joung et al. |
| 2015/0020223 A1 | 1/2015 | Zhang et al. |
| 2015/0024499 A1 | 1/2015 | Brouns et al. |
| 2015/0024500 A1 | 1/2015 | Yu et al. |
| 2015/0031132 A1 | 1/2015 | Church et al. |
| 2015/0031133 A1 | 1/2015 | Church et al. |
| 2015/0031134 A1 | 1/2015 | Zhang et al. |
| 2015/0044772 A1 | 2/2015 | Zhao |
| 2015/0045546 A1 | 2/2015 | Siksnys et al. |
| 2015/0050699 A1 | 2/2015 | Siksnys et al. |
| 2015/0056705 A1 | 2/2015 | Conway et al. |
| 2015/0071889 A1 | 3/2015 | Musunuru et al. |
| 2015/0071898 A1 | 3/2015 | Liu et al. |
| 2015/0071899 A1 | 3/2015 | Liu et al. |
| 2015/0079680 A1 | 3/2015 | Bradley et al. |
| 2015/0079681 A1 | 3/2015 | Zhang |
| 2015/0128300 A1 | 5/2015 | Warming et al. |
| 2015/0140664 A1 | 5/2015 | Byrne et al. |
| 2015/0159174 A1 | 6/2015 | Frendewey et al. |
| 2015/0159175 A1 | 6/2015 | Frendewey et al. |
| 2015/0176013 A1 | 6/2015 | Musunuru et al. |
| 2015/0184139 A1 | 7/2015 | Zhang et al. |
| 2015/0184199 A1 | 7/2015 | Horwitz et al. |
| 2015/0203872 A1 | 7/2015 | Zhang |
| 2015/0232833 A1 | 8/2015 | Mali et al. |
| 2015/0232882 A1 | 8/2015 | Zhang et al. |
| 2015/0240261 A1 | 8/2015 | Siksnys et al. |
| 2015/0240263 A1 | 8/2015 | Holmes et al. |
| 2015/0247150 A1 | 9/2015 | Zhang et al. |
| 2015/0259684 A1 | 9/2015 | Church et al. |
| 2015/0259704 A1 | 9/2015 | Church et al. |
| 2015/0284727 A1 | 10/2015 | Kim et al. |
| 2015/0291961 A1 | 10/2015 | Siksnys et al. |
| 2015/0291965 A1 | 10/2015 | Zhang et al. |
| 2015/0291966 A1 | 10/2015 | Zhang et al. |
| 2015/0322457 A1 | 11/2015 | Kim et al. |
| 2015/0344912 A1 | 12/2015 | Kim et al. |
| 2015/0353905 A1 | 12/2015 | Weiss et al. |
| 2015/0353917 A1 | 12/2015 | Miller |
| 2015/0356239 A1 | 12/2015 | Zhang et al. |
| 2015/0376645 A1 | 12/2015 | Zechiedrich et al. |
| 2016/0002670 A1 | 1/2016 | Church et al. |
| 2016/0010076 A1 | 1/2016 | Joung et al. |
| 2016/0010154 A1 | 1/2016 | Laganiere et al. |
| 2016/0017366 A1 | 1/2016 | Chen et al. |
| 2016/0024523 A1 | 1/2016 | Joung et al. |
| 2016/0024524 A1 | 1/2016 | Joung et al. |
| 2016/0024529 A1 | 1/2016 | Carstens |
| 2016/0029604 A1 | 2/2016 | Fahrenkrug et al. |
| 2016/0032274 A1 | 2/2016 | Church et al. |
| 2016/0032292 A1 | 2/2016 | Storici et al. |
| 2016/0040155 A1 | 2/2016 | Maizels et al. |
| 2016/0046949 A1 | 2/2016 | May et al. |
| 2016/0046961 A1 | 2/2016 | Jinek et al. |
| 2016/0046962 A1 | 2/2016 | May et al. |
| 2016/0046963 A1 | 2/2016 | May et al. |
| 2016/0046978 A1 | 2/2016 | May et al. |
| 2016/0060653 A1 | 3/2016 | Doudna et al. |
| 2016/0060654 A1 | 3/2016 | Doudna et al. |
| 2016/0060657 A1 | 3/2016 | Frendewey et al. |
| 2016/0068864 A1 | 3/2016 | Doudna et al. |
| 2016/0068887 A1 | 3/2016 | May et al. |
| 2016/0076020 A1 | 3/2016 | May et al. |
| 2016/0090607 A1 | 3/2016 | Conway et al. |
| 2016/0102324 A1 | 4/2016 | Duchateau et al. |
| 2016/0108470 A1 | 4/2016 | May et al. |
| 2016/0115488 A1 | 4/2016 | Zhang et al. |
| 2016/0115489 A1 | 4/2016 | Zhang et al. |
| 2016/0122774 A1 | 5/2016 | Duchateau et al. |
| 2016/0130608 A1 | 5/2016 | Doudna et al. |
| 2016/0130609 A1 | 5/2016 | Doudna et al. |
| 2016/0138008 A1 | 5/2016 | Doudna et al. |
| 2016/0138046 A1 | 5/2016 | Wu |
| 2016/0145644 A1 | 5/2016 | Cost et al. |
| 2016/0145646 A1 | 5/2016 | Frendewey et al. |
| 2016/0153003 A1 | 6/2016 | Joung et al. |
| 2016/0153004 A1 | 6/2016 | Zhang et al. |
| 2016/0153006 A1 | 6/2016 | Zhang et al. |
| 2016/0160210 A1 | 6/2016 | Mali et al. |
| 2016/0160291 A1 | 6/2016 | Scully et al. |
| 2016/0168592 A1 | 6/2016 | Church et al. |
| 2016/0175462 A1 | 6/2016 | Zhang et al. |
| 2016/0177340 A1 | 6/2016 | Bradley et al. |
| 2016/0184362 A1 | 6/2016 | Duchateau et al. |
| 2016/0186152 A1 | 6/2016 | Brouns et al. |
| 2016/0186213 A1 | 6/2016 | Zhang et al. |
| 2016/0186214 A1 | 6/2016 | Brouns et al. |
| 2016/0201089 A1 | 7/2016 | Gersbach et al. |
| 2016/0207983 A1 | 7/2016 | Bradley et al. |
| 2016/0208243 A1 | 7/2016 | Zhang et al. |
| 2016/0215276 A1 | 7/2016 | Liu et al. |
| 2016/0222416 A1 | 8/2016 | Church et al. |
| 2016/0237455 A1 | 8/2016 | Glucksmann et al. |
| 2016/0237456 A1 | 8/2016 | Church et al. |
| 2016/0251640 A1 | 9/2016 | May et al. |
| 2016/0257948 A1 | 9/2016 | Bradley et al. |
| 2016/0257974 A1 | 9/2016 | Bradley et al. |
| 2016/0264995 A1 | 9/2016 | Yamamoto et al. |
| 2016/0272965 A1 | 9/2016 | Zhang et al. |
| 2016/0281072 A1 | 9/2016 | Zhang |
| 2016/0281111 A1 | 9/2016 | Cotta-Ramusino et al. |
| 2016/0298097 A1 | 10/2016 | Chavez et al. |
| 2016/0298125 A1 | 10/2016 | Chen et al. |
| 2016/0298132 A1 | 10/2016 | Chen et al. |
| 2016/0298133 A1 | 10/2016 | Chen et al. |
| 2016/0298134 A1 | 10/2016 | Chen et al. |

(56) References Cited

U.S. PATENT DOCUMENTS

| | | |
|---|---|---|
| 2016/0298135 A1 | 10/2016 | Chen et al. |
| 2016/0298136 A1 | 10/2016 | Chen et al. |
| 2016/0298137 A1 | 10/2016 | Chen et al. |
| 2016/0298138 A1 | 10/2016 | Chen et al. |
| 2016/0304855 A1 | 10/2016 | Stark et al. |
| 2016/0304907 A1 | 10/2016 | Mali et al. |
| 2016/0312198 A1 | 10/2016 | Joung et al. |
| 2016/0312199 A1 | 10/2016 | Joung et al. |
| 2016/0312280 A1 | 10/2016 | May et al. |
| 2016/0319260 A1 | 11/2016 | Joung et al. |
| 2016/0319261 A1 | 11/2016 | Joung et al. |
| 2016/0319281 A1 | 11/2016 | Tsai et al. |
| 2016/0319349 A1 | 11/2016 | May et al. |
| 2016/0340662 A1 | 11/2016 | Zhang et al. |
| 2016/0355796 A1 | 12/2016 | Davidson et al. |
| 2016/0355797 A1 | 12/2016 | Konermann et al. |
| 2016/0355816 A1 | 12/2016 | Terns et al. |
| 2016/0369258 A1 | 12/2016 | Maizels et al. |
| 2016/0376610 A1 | 12/2016 | Davis et al. |
| 2017/0002380 A1 | 1/2017 | Buerckstuemmer |
| 2017/0009256 A1 | 1/2017 | Buerckstuemmer |
| 2017/0016027 A1 | 1/2017 | Lee et al. |
| 2017/0029805 A1 | 2/2017 | Li et al. |
| 2017/0037416 A1 | 2/2017 | Barrangou et al. |
| 2017/0044569 A9 | 2/2017 | Church et al. |
| 2017/0051276 A1 | 2/2017 | May et al. |
| 2017/0051310 A1 | 2/2017 | Doudna et al. |
| 2017/0051312 A1 | 2/2017 | Jinek et al. |
| 2017/0058271 A1 | 3/2017 | Joung et al. |
| 2017/0058272 A1 | 3/2017 | Carter et al. |
| 2017/0058298 A1 | 3/2017 | Kennedy et al. |
| 2017/0058299 A1 | 3/2017 | Horwitz et al. |
| 2017/0067078 A1 | 3/2017 | Frendewey et al. |
| 2017/0073705 A1 | 3/2017 | Chen et al. |
| 2017/0081650 A1 | 3/2017 | Joung et al. |
| 2017/0107536 A1 | 4/2017 | Zhang et al. |
| 2017/0152508 A1 | 6/2017 | Joung et al. |
| 2017/0152528 A1 | 6/2017 | Zhang |
| 2017/0166875 A1 | 6/2017 | Maizels et al. |
| 2017/0166893 A1 | 6/2017 | Doudna et al. |
| 2017/0166903 A1 | 6/2017 | Zhang et al. |
| 2017/0175140 A1 | 6/2017 | Hummel et al. |
| 2017/0175142 A1 | 6/2017 | Zhang et al. |
| 2017/0175144 A1 | 6/2017 | Zhang et al. |
| 2017/0191078 A1 | 7/2017 | Zhang et al. |
| 2017/0191082 A1 | 7/2017 | Chen et al. |
| 2017/0198269 A1 | 7/2017 | Zhang et al. |
| 2017/0198277 A1 | 7/2017 | Kmiec et al. |
| 2017/0198302 A1 | 7/2017 | Feng et al. |
| 2017/0211142 A1 | 7/2017 | Smargon et al. |
| 2017/0233703 A1 | 8/2017 | Xie et al. |
| 2017/0251647 A1 | 9/2017 | Mashimo et al. |
| 2017/0260547 A1 | 9/2017 | Dombrowski et al. |
| 2017/0268022 A1 | 9/2017 | Liu et al. |
| 2017/0273284 A1 | 9/2017 | Shen |
| 2017/0275611 A1 | 9/2017 | Bradley et al. |
| 2017/0298330 A1 | 10/2017 | Sato et al. |
| 2017/0306306 A1 | 10/2017 | Potter et al. |
| 2017/0306307 A1 | 10/2017 | Zhang et al. |
| 2017/0327805 A1 | 11/2017 | Joung et al. |
| 2017/0327806 A1 | 11/2017 | Joung et al. |
| 2017/0327820 A1 | 11/2017 | May et al. |
| 2017/0349915 A1 | 12/2017 | May et al. |
| 2017/0362611 A1 | 12/2017 | Tsai |
| 2018/0002682 A1 | 1/2018 | Sternberg et al. |
| 2018/0016601 A1 | 1/2018 | Qi et al. |
| 2018/0030425 A1 | 2/2018 | Joung et al. |
| 2018/0044700 A1 | 2/2018 | Doudna et al. |
| 2018/0049412 A1 | 2/2018 | Shen |
| 2018/0051298 A1 | 2/2018 | Fahrenkrug et al. |
| 2018/0066242 A1 | 3/2018 | Zhang et al. |
| 2018/0073002 A1 | 3/2018 | Deiters et al. |
| 2018/0073039 A1 | 3/2018 | Durocher et al. |
| 2018/0080051 A1 | 3/2018 | Sheikh et al. |
| 2018/0100148 A1 | 4/2018 | Vakulskas et al. |
| 2018/0105564 A1 | 4/2018 | Davis et al. |
| 2018/0112235 A1 | 4/2018 | Li et al. |
| 2018/0119121 A1 | 5/2018 | Brouns et al. |
| 2018/0119175 A1 | 5/2018 | Conway et al. |
| 2018/0127780 A1 | 5/2018 | Liu et al. |
| 2018/0127785 A1 | 5/2018 | Junge et al. |
| 2018/0127787 A1 | 5/2018 | Gurumurthy et al. |
| 2018/0135073 A1 | 5/2018 | Chen et al. |
| 2018/0142262 A1 | 5/2018 | Webber et al. |
| 2018/0148735 A1 | 5/2018 | Begemann et al. |
| 2018/0155708 A1 | 6/2018 | Church et al. |
| 2018/0155716 A1 | 6/2018 | Zhang et al. |
| 2018/0163188 A1 | 6/2018 | Xie et al. |
| 2018/0163213 A1 | 6/2018 | Aneja et al. |
| 2018/0187176 A1 | 7/2018 | Behlke et al. |
| 2018/0187195 A1 | 7/2018 | Siksnys et al. |
| 2018/0208931 A1 | 7/2018 | Doudna et al. |
| 2018/0216088 A1 | 8/2018 | Joung et al. |
| 2018/0216135 A1 | 8/2018 | Tsai et al. |
| 2018/0230494 A1 | 8/2018 | Joung et al. |
| 2018/0230495 A1 | 8/2018 | Doudna et al. |
| 2018/0230496 A1 | 8/2018 | Doudna et al. |
| 2018/0230497 A1 | 8/2018 | Doudna et al. |
| 2018/0235194 A1 | 8/2018 | Fahrenkrug et al. |
| 2018/0237801 A1 | 8/2018 | Doudna et al. |
| 2018/0245100 A1 | 8/2018 | Doudna et al. |
| 2018/0245101 A1 | 8/2018 | Doudna et al. |
| 2018/0250424 A1 | 9/2018 | Cotta-Ramusino |
| 2018/0251791 A1 | 9/2018 | Doudna et al. |
| 2018/0251793 A1 | 9/2018 | Doudna et al. |
| 2018/0251794 A1 | 9/2018 | Doudna et al. |
| 2018/0251795 A1 | 9/2018 | Charpentier et al. |
| 2018/0265864 A1 | 9/2018 | Li et al. |
| 2018/0273932 A1 | 9/2018 | Bothmer et al. |
| 2018/0273981 A1 | 9/2018 | Doudna et al. |
| 2018/0282713 A1 | 10/2018 | Van Der Oost |
| 2018/0282714 A1 | 10/2018 | Joung et al. |
| 2018/0282764 A1 | 10/2018 | Jinek et al. |
| 2018/0291383 A1 | 10/2018 | Musunuru et al. |
| 2018/0298360 A1 | 10/2018 | Sternberg et al. |
| 2018/0298406 A1 | 10/2018 | Doudna et al. |
| 2018/0298407 A1 | 10/2018 | Doudna et al. |
| 2018/0305697 A1 | 10/2018 | Sfeir et al. |
| 2018/0305718 A1 | 10/2018 | Nelson et al. |
| 2018/0305719 A1 | 10/2018 | Perez-Pinera et al. |
| 2018/0312824 A1 | 11/2018 | Zhang et al. |
| 2018/0312874 A1 | 11/2018 | Doudna et al. |
| 2018/0312875 A1 | 11/2018 | Doudna et al. |
| 2018/0312876 A1 | 11/2018 | Doudna et al. |

FOREIGN PATENT DOCUMENTS

| | | |
|---|---|---|
| WO | WO-2007/120726 A2 | 10/2007 |
| WO | WO-2010/011961 A2 | 1/2010 |
| WO | WO-2013/098244 A1 | 7/2013 |
| WO | WO-2013/141680 A1 | 9/2013 |
| WO | WO-2013/142578 A1 | 9/2013 |
| WO | WO-2013/176772 A1 | 11/2013 |
| WO | WO-2013/188522 A2 | 12/2013 |
| WO | WO-2014/018423 A2 | 1/2014 |
| WO | WO-2014/065596 A1 | 5/2014 |
| WO | WO-2014/089290 A1 | 6/2014 |
| WO | WO-2014/093479 A1 | 6/2014 |
| WO | WO-2014/093595 A1 | 6/2014 |
| WO | WO-2014/093622 A2 | 6/2014 |
| WO | WO-2014/093635 A1 | 6/2014 |
| WO | WO-2014/093655 A2 | 6/2014 |
| WO | WO-2014/093661 A2 | 6/2014 |
| WO | WO-2014/093694 A1 | 6/2014 |
| WO | WO-2014/093701 A1 | 6/2014 |
| WO | WO-2014/093709 A1 | 6/2014 |
| WO | WO-2014/093712 A1 | 6/2014 |
| WO | WO-2014/093718 A1 | 6/2014 |
| WO | WO-2014/099744 A1 | 6/2014 |
| WO | WO-2014/099750 A2 | 6/2014 |
| WO | WO-2014/113493 A1 | 7/2014 |
| WO | WO-2014/127287 A1 | 8/2014 |
| WO | WO-2014/143381 A1 | 9/2014 |
| WO | WO-2014/144288 A1 | 9/2014 |

(56) References Cited

FOREIGN PATENT DOCUMENTS

| | | |
|---|---|---|
| WO | WO-2014/144592 A2 | 9/2014 |
| WO | WO-2014/144761 A2 | 9/2014 |
| WO | WO-2014/145599 A2 | 9/2014 |
| WO | WO-2014/150624 A1 | 9/2014 |
| WO | WO-2014/152432 A2 | 9/2014 |
| WO | WO-2014/165825 A2 | 10/2014 |
| WO | WO-2014/172458 A1 | 10/2014 |
| WO | WO-2014/186585 A2 | 11/2014 |
| WO | WO-2014/191518 A1 | 12/2014 |
| WO | WO-2014/191521 A2 | 12/2014 |
| WO | WO-2014/197568 A2 | 12/2014 |
| WO | WO-2014/197748 A2 | 12/2014 |
| WO | WO-2014/201015 A2 | 12/2014 |
| WO | WO-2014/204578 A1 | 12/2014 |
| WO | WO-2014/204724 A1 | 12/2014 |
| WO | WO-2014/204725 A1 | 12/2014 |
| WO | WO-2014/204727 A1 | 12/2014 |
| WO | WO-2014/204728 A1 | 12/2014 |
| WO | WO-2014/204729 A1 | 12/2014 |
| WO | WO-2015/006290 A1 | 1/2015 |
| WO | WO-2015/006294 A2 | 1/2015 |
| WO | WO-2015/010114 A1 | 1/2015 |
| WO | WO-2015/013583 A2 | 1/2015 |
| WO | WO-2015/021426 A1 | 2/2015 |
| WO | WO-2015/035162 A2 | 3/2015 |
| WO | WO-2015/040402 A1 | 3/2015 |
| WO | WO-2015/048577 A2 | 4/2015 |
| WO | WO-2015/048690 A1 | 4/2015 |
| WO | WO-2015/077318 A1 | 5/2015 |
| WO | WO-2015/079056 A1 | 6/2015 |
| WO | WO-2015/088643 A1 | 6/2015 |
| WO | WO-2015/089351 A1 | 6/2015 |
| WO | WO-2015/089354 A1 | 6/2015 |
| WO | WO-2015/089427 A1 | 6/2015 |
| WO | WO-2015/089486 A2 | 6/2015 |
| WO | WO-2015/095804 A1 | 6/2015 |
| WO | WO-2015/127439 A1 | 8/2015 |
| WO | WO-2015/138620 A1 | 9/2015 |
| WO | WO-2015/160683 A1 | 10/2015 |
| WO | WO-2015/168125 A1 | 11/2015 |
| WO | WO-2015/188056 A1 | 12/2015 |
| WO | WO-2015/188065 A1 | 12/2015 |
| WO | WO-2016/022363 A2 | 2/2016 |
| WO | WO-2016/025759 A1 | 2/2016 |
| WO | WO-2016/036754 A1 | 3/2016 |
| WO | WO-2016/054326 A1 | 4/2016 |
| WO | WO-2016/057961 A1 | 4/2016 |
| WO | WO-2016/065364 A1 | 4/2016 |
| WO | WO-2016/073990 A2 | 5/2016 |
| WO | WO-2016/081923 A2 | 5/2016 |
| WO | WO-2016/090385 A1 | 6/2016 |
| WO | WO-2016/100819 A1 | 6/2016 |
| WO | WO-2016/106236 A1 | 6/2016 |
| WO | WO-2016/106244 A1 | 6/2016 |
| WO | WO-2016/112242 A1 | 7/2016 |
| WO | WO-2016/114972 A1 | 7/2016 |
| WO | WO-2016/115326 A1 | 7/2016 |
| WO | WO-2016/138574 A1 | 9/2016 |
| WO | WO-2016/141224 A1 | 9/2016 |
| WO | WO-2016/142719 A1 | 9/2016 |
| WO | WO-2016/154579 A2 | 9/2016 |
| WO | WO-2016/161207 A1 | 10/2016 |
| WO | WO-2016/164797 A1 | 10/2016 |
| WO | WO-2016/166340 A1 | 10/2016 |
| WO | WO-2016/167300 A1 | 10/2016 |
| WO | WO-2016/183448 A1 | 11/2016 |
| WO | WO-2016/195598 A1 | 12/2016 |
| WO | WO-2016/196655 A1 | 12/2016 |
| WO | WO-2016/196887 A1 | 12/2016 |
| WO | WO-2016/205613 A1 | 12/2016 |
| WO | WO-2016/205711 A1 | 12/2016 |
| WO | WO-2016/205749 A1 | 12/2016 |
| WO | WO-2016/205759 A1 | 12/2016 |
| WO | WO-2016/210271 A1 | 12/2016 |
| WO | WO-2017/011519 A1 | 1/2017 |
| WO | WO-2017/015015 A1 | 1/2017 |
| WO | WO-2017/015101 A1 | 1/2017 |
| WO | WO-2017/031483 A1 | 2/2017 |
| WO | WO-2017/040348 A1 | 3/2017 |
| WO | WO-2017/040511 A1 | 3/2017 |
| WO | WO-2017/040709 A1 | 3/2017 |
| WO | WO-2017/048969 A1 | 3/2017 |
| WO | WO-2017/053729 A1 | 3/2017 |
| WO | WO-2017/053879 A1 | 3/2017 |
| WO | WO-2017/062754 A1 | 4/2017 |
| WO | WO-2017/064546 A1 | 4/2017 |
| WO | WO-2017/066588 A2 | 4/2017 |
| WO | WO-2017/070633 A2 | 4/2017 |
| WO | WO-2017/074962 A1 | 5/2017 |
| WO | WO-2017/096041 A1 | 6/2017 |
| WO | WO-2017/099494 A1 | 6/2017 |
| WO | WO-2017/123609 A1 | 7/2017 |
| WO | WO-2017/127807 A1 | 7/2017 |
| WO | WO-2017/129811 A1 | 8/2017 |
| WO | WO-2017/136335 A1 | 8/2017 |
| WO | WO-2017/142923 A1 | 8/2017 |
| WO | WO-2017/147056 A1 | 8/2017 |
| WO | WO-2017/160752 A1 | 9/2017 |
| WO | WO-2017/161068 A1 | 9/2017 |
| WO | WO-2017/165655 A1 | 9/2017 |
| WO | WO-2017/165826 A1 | 9/2017 |
| WO | WO-2017/172775 A1 | 10/2017 |
| WO | WO-2017/180694 A1 | 10/2017 |
| WO | WO-2017/180711 A1 | 10/2017 |
| WO | WO-2017/181107 A2 | 10/2017 |
| WO | WO-2017/184768 A1 | 10/2017 |
| WO | WO-2017/186550 A1 | 11/2017 |
| WO | WO-2017/186718 A1 | 11/2017 |
| WO | WO-2017/189308 A1 | 11/2017 |
| WO | WO-2017/189336 A1 | 11/2017 |
| WO | WO-2017/197238 A1 | 11/2017 |
| WO | WO-2017/201311 A2 | 11/2017 |
| WO | WO-2017/205650 A1 | 11/2017 |
| WO | WO-2017/207589 A1 | 12/2017 |
| WO | WO-2017/212264 A1 | 12/2017 |
| WO | WO-2017/215648 A1 | 12/2017 |
| WO | WO-2017/216771 A2 | 12/2017 |
| WO | WO-2017/219027 A1 | 12/2017 |
| WO | WO-2017/219033 A1 | 12/2017 |
| WO | WO-2017/220527 A1 | 12/2017 |
| WO | WO-2017/222773 A1 | 12/2017 |
| WO | WO-2018/013840 A1 | 1/2018 |
| WO | WO-2018/013932 A1 | 1/2018 |
| WO | WO-2018/015936 A2 | 1/2018 |
| WO | WO-2018/022634 A1 | 2/2018 |
| WO | WO-2018/025206 A1 | 2/2018 |
| WO | WO-2018/030208 A1 | 2/2018 |
| WO | WO-2018/030457 A1 | 2/2018 |
| WO | WO-2018/033110 A1 | 2/2018 |
| WO | WO-2018/035387 A1 | 2/2018 |
| WO | WO-2018/035388 A1 | 2/2018 |
| WO | WO-2018/035423 A1 | 2/2018 |
| WO | WO-2018/049073 A1 | 3/2018 |
| WO | WO-2018/049077 A1 | 3/2018 |
| WO | WO-2018/049079 A1 | 3/2018 |
| WO | WO-2018/049168 A1 | 3/2018 |
| WO | WO-2018/052247 A1 | 3/2018 |
| WO | WO-2018/053053 A1 | 3/2018 |
| WO | WO-2018/064352 A1 | 4/2018 |
| WO | WO-2018/064371 A1 | 4/2018 |
| WO | WO-2018/068053 A2 | 4/2018 |
| WO | WO-2018/069474 A1 | 4/2018 |
| WO | WO-2018/071663 A1 | 4/2018 |
| WO | WO-2018/071868 A1 | 4/2018 |
| WO | WO-2018/071892 A1 | 4/2018 |
| WO | WO-2018/074979 A1 | 4/2018 |
| WO | WO-2018/081470 A1 | 5/2018 |
| WO | WO-2018/081476 A2 | 5/2018 |
| WO | WO-2018/089437 A1 | 5/2018 |
| WO | WO-2018/089664 A1 | 5/2018 |
| WO | WO-2018/096356 A1 | 5/2018 |
| WO | WO-2018/097257 A1 | 5/2018 |
| WO | WO-2018/098383 A1 | 5/2018 |
| WO | WO-2018/108272 A1 | 6/2018 |

(56) References Cited

FOREIGN PATENT DOCUMENTS

| WO | WO-2018/108338 A1 | 6/2018 |
| WO | WO-2018/108339 A1 | 6/2018 |
| WO | WO-2018/109101 A1 | 6/2018 |
| WO | WO-2018/112451 A1 | 6/2018 |
| WO | WO-2018/119060 A1 | 6/2018 |
| WO | WO-2018/138385 A1 | 8/2018 |
| WO | WO-2018/144546 A1 | 8/2018 |
| WO | WO-2018/149888 A1 | 8/2018 |
| WO | WO-2018/152325 A1 | 8/2018 |
| WO | WO-2018/162702 A1 | 9/2018 |
| WO | WO-2018/170015 A1 | 9/2018 |
| WO | WO-2018/172556 A1 | 9/2018 |
| WO | WO-2018/175872 A1 | 9/2018 |
| WO | WO-2018/188571 A1 | 10/2018 |
| WO | WO-2018/191715 A2 | 10/2018 |
| WO | WO-2018/195313 A1 | 10/2018 |
| WO | WO-2018/195418 A1 | 10/2018 |
| WO | WO-2018/195540 A1 | 10/2018 |
| WO | WO-2018/195545 A2 | 10/2018 |
| WO | WO-2018/195555 A1 | 10/2018 |
| WO | WO-2018/197020 A1 | 11/2018 |
| WO | WO-2018/197495 A1 | 11/2018 |

OTHER PUBLICATIONS

Cho et al. (2014) "Analysis of off-target effects of CRISPR/Cas-derived RNA-guided endonucleases and nickases", *Genome Res.* 24(1): 132-41 (published online Nov. 19, 2013).

Cong et al. (2013) "Multiplex Genome Engineering Using CRISPR/Cas systems", *Science* 339(6121): 819-23. Supplemental Information at pp. 10-34.

Hollywood (2013) "Cystic fibrosis gene repair: Correction of ΔF508 using ZFN and CRISPR/Cas9 guide RNA gene editing tools", Ph.D. Thesis, 193 pages, available at http://hdl.handle.net/10468/1407.

International Search Report of the International Searching Authority for PCT/US2015/059782, dated Jun. 21, 2016, 11 pages.

International Preliminary Report on Patentability and Written Opinion of the International Searching Authority for PCT/US2015/059782, dated May 18, 2017, 19 pages.

Mali et al. (2013) "CAS9 transcriptional activators for target specificity screening and paired nickases for cooperative genome engineering", *Nat. Biotechnol.* 31 (9): 833-8. Supplementary Information at pp. 7-22.

Mali et al. (2013) "RNA-Guided Human Genome Engineering via Cas9", *Science* 339(6121): 823-6.

Ran et al. (2013) "Double Nicking by RNA-Guided CRISPR Cas9 for Enhanced Genome Editing Specificity", *Cell* 154(6): 1380-9.

Ran et al. (2013) "Genome engineering using the CRISPR-Cas9 system", *Nat. Protoc.* 8(11): 2281-308.

Siupianek et al. (2002) "Fusion Tyrosine Kinases Induce Drug Resistance by Stimulation of Homology-Dependent Recombination Repair, Prolongation of $G_2$/M Phase, and Protection from Apoptosis", *Mol. Cell. Biol.* 22(12): 4189-201.

Trevino and Zhang (2014) "Genome Editing Using Cas9 Nickases", *Methods in Enzymology* 546(12): 161-174 (published online Nov. 12, 2014).

Davis et al., Homology-directed repair of DNA nicks via pathways distinct from canonical double-strand break repair. Proc Natl Acad Sci USA. Mar. 11, 2014;111(10):E924-32.

\* cited by examiner

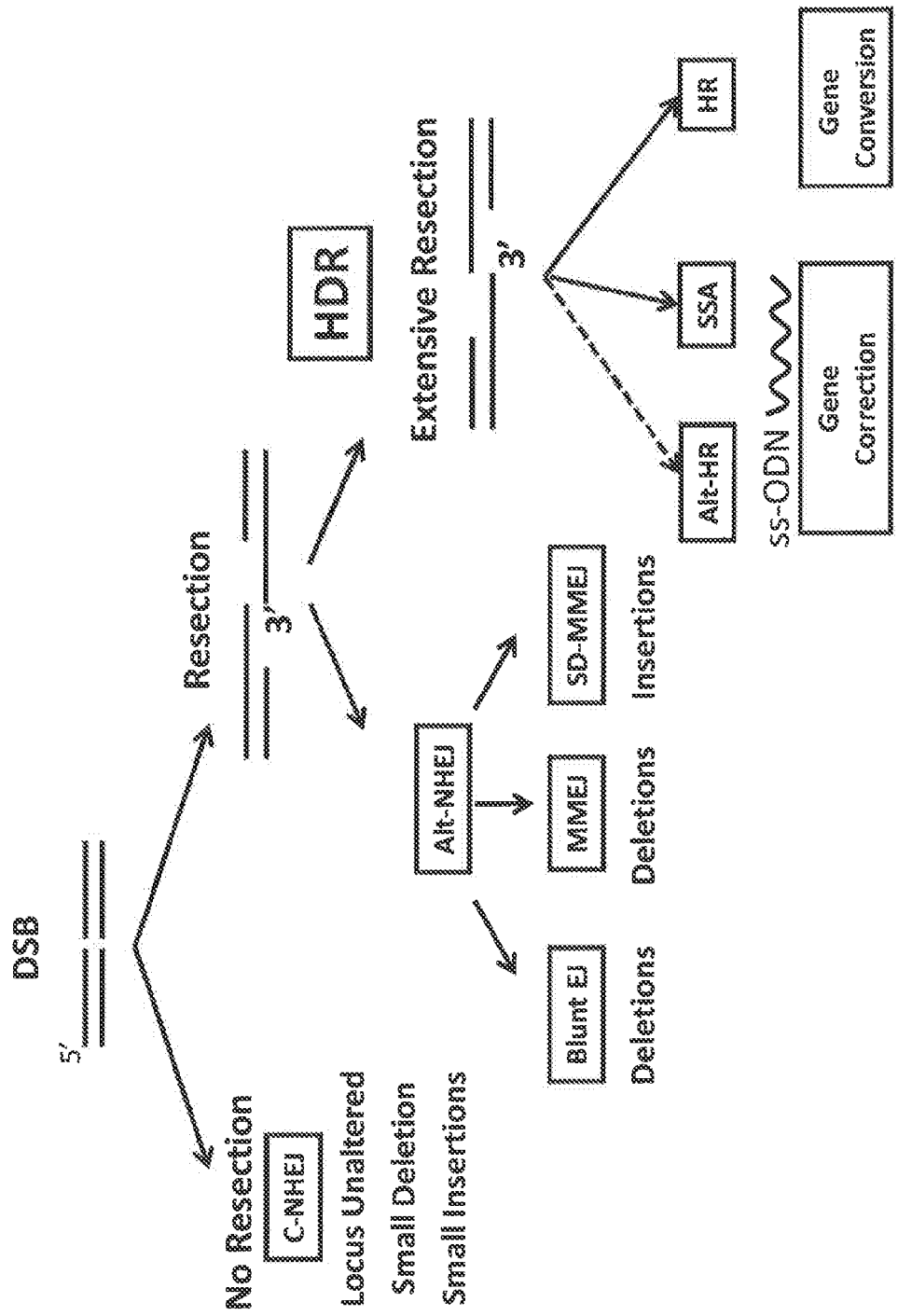

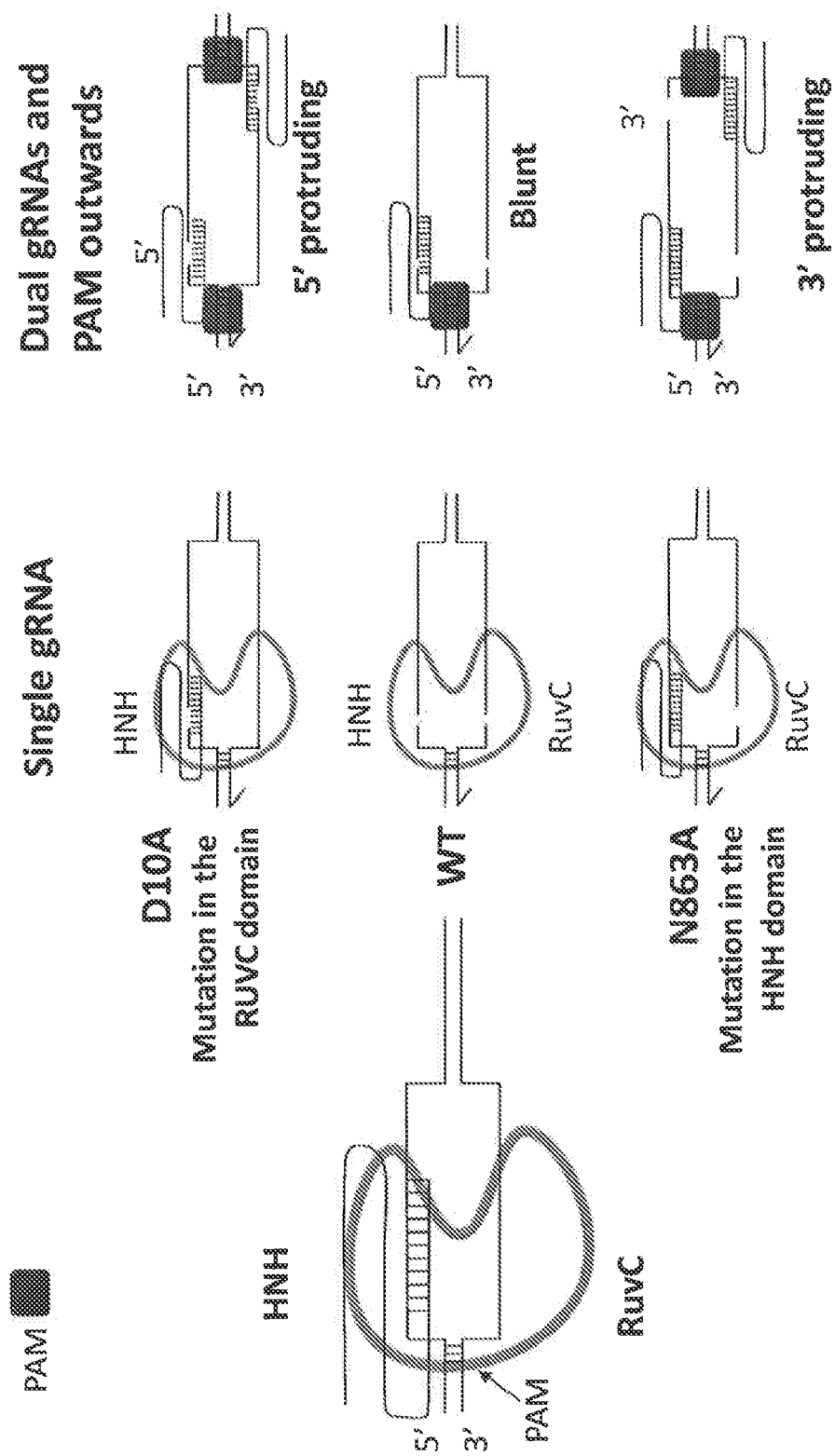
Figure 2: Cartoon representing the different Cas9 variants positioning

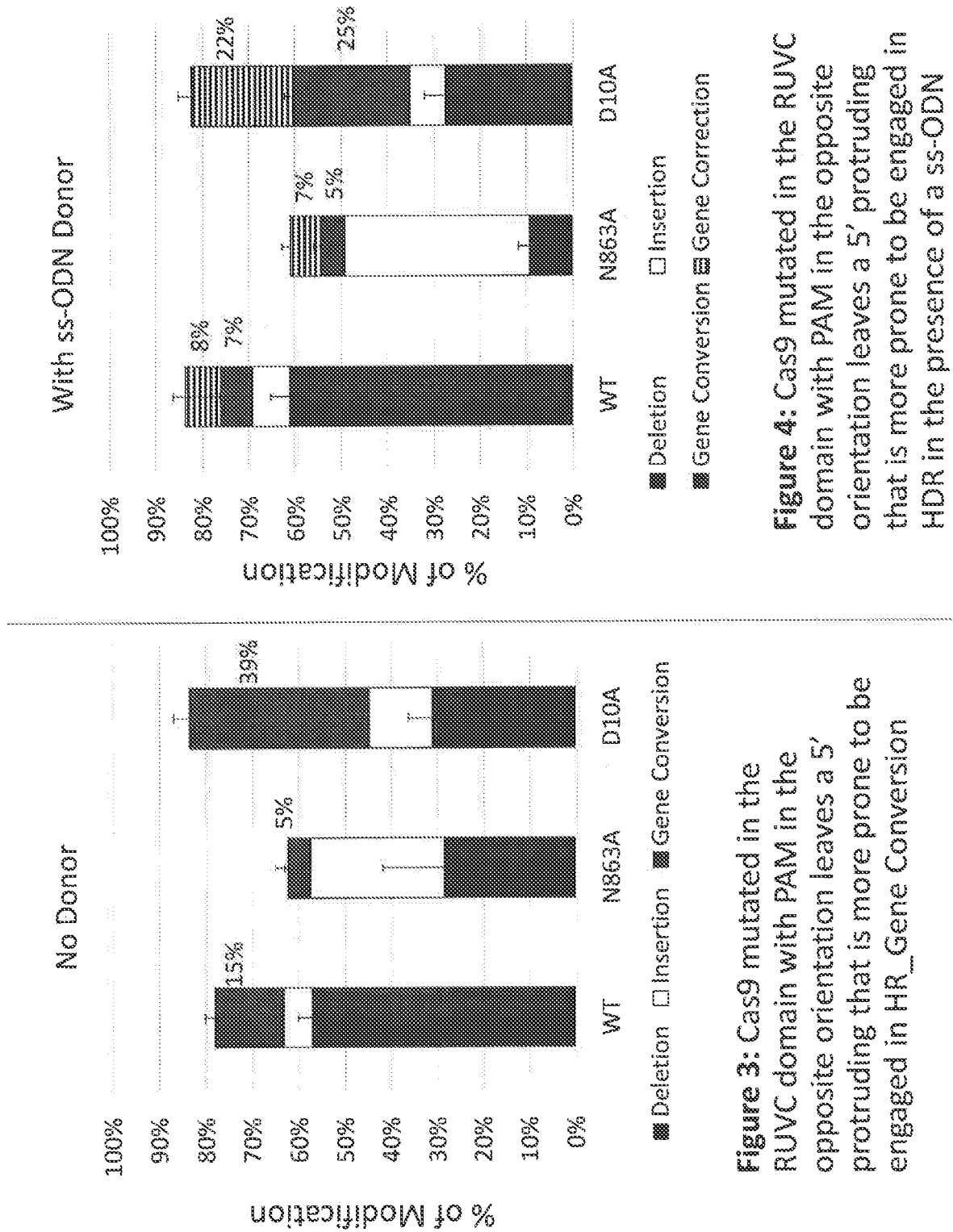
Figure 3: Cas9 mutated in the RUVC domain with PAM in the opposite orientation leaves a 5' protruding that is more prone to be engaged in HR_Gene Conversion
Figure 4: Cas9 mutated in the RUVC domain with PAM in the opposite orientation leaves a 5' protruding that is more prone to be engaged in HDR in the presence of a ss-ODN

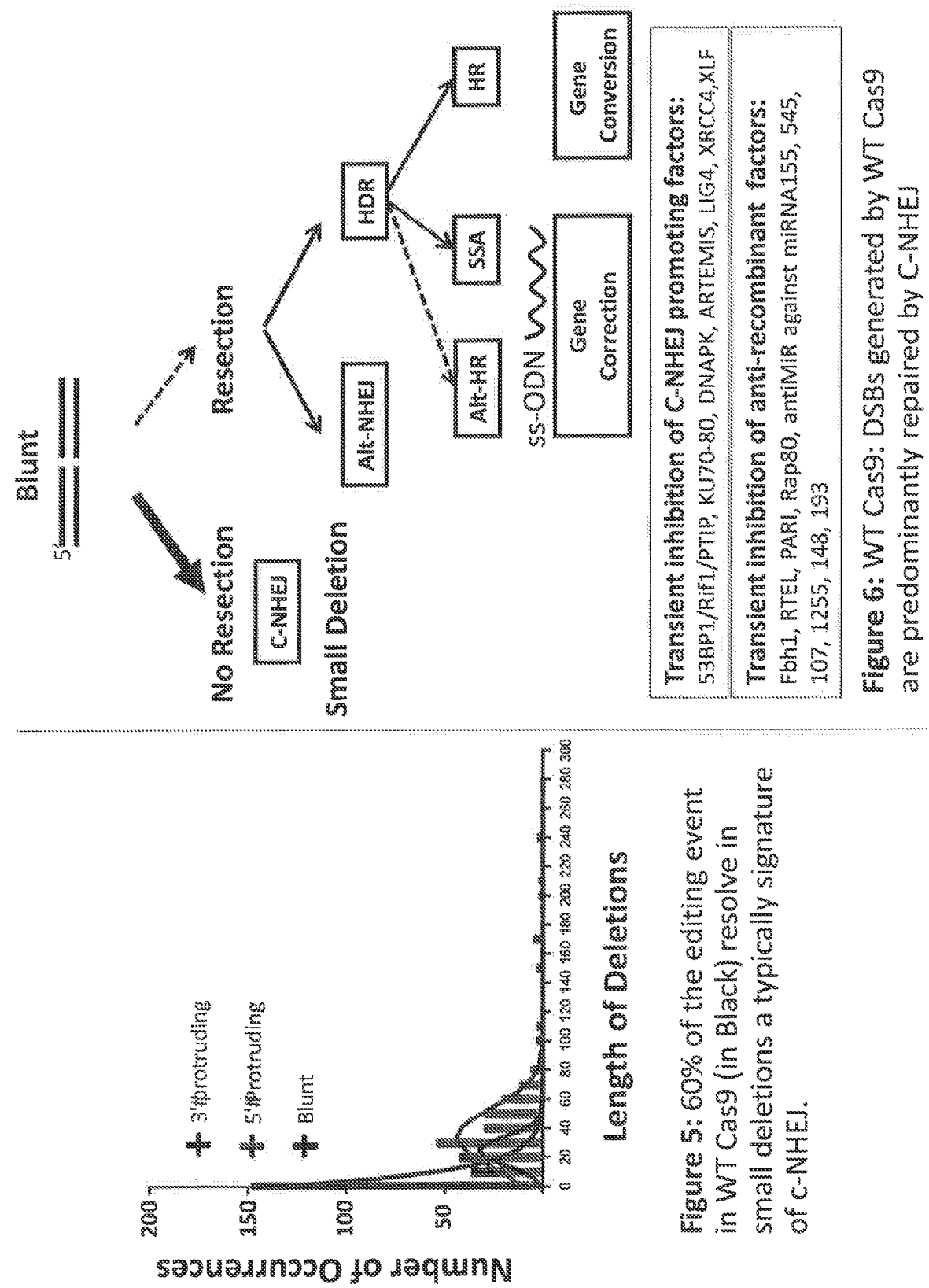
Figure 5: 60% of the editing event in WT Cas9 (in Black) resolve in small deletions a typically signature of c-NHEJ.
Figure 6: WT Cas9: DSBs generated by WT Cas9 are predominantly repaired by C-NHEJ

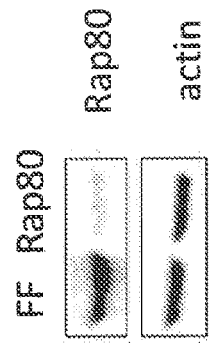
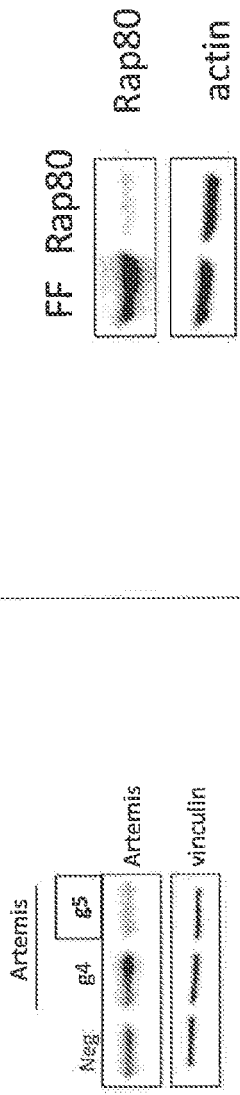
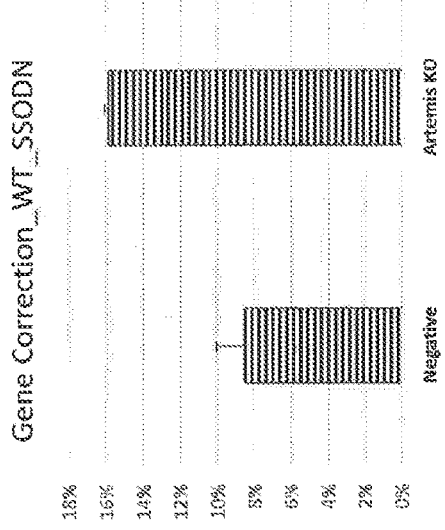
Figure 7A
Figure 7B
Figure 7: Down regulation of Artemis leads to increase of Gene Correction mediated by ss-ODN
Figure 8: Western Blot Showing down regulation of Rad80 with siRNA.

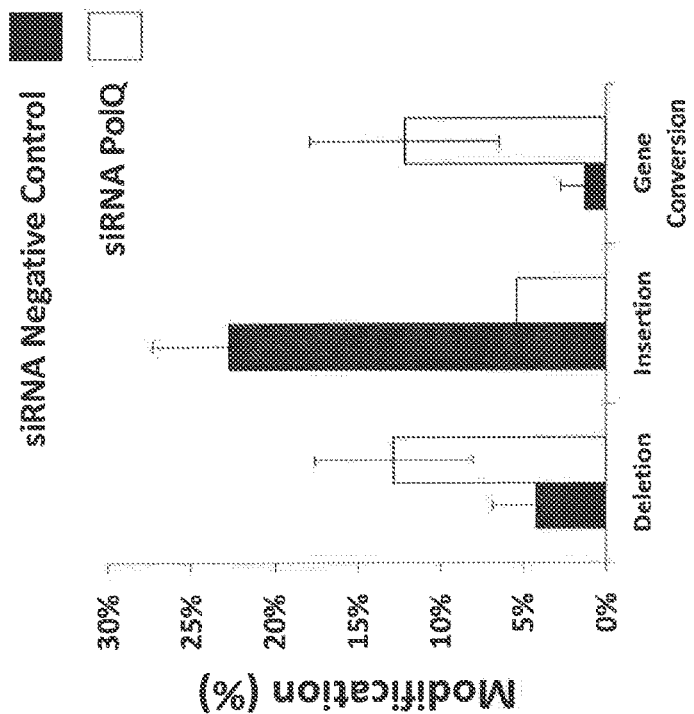
Figure 10: Down regulation of Pol theta leads to increase of Gene Conversion and a decrease of insertions
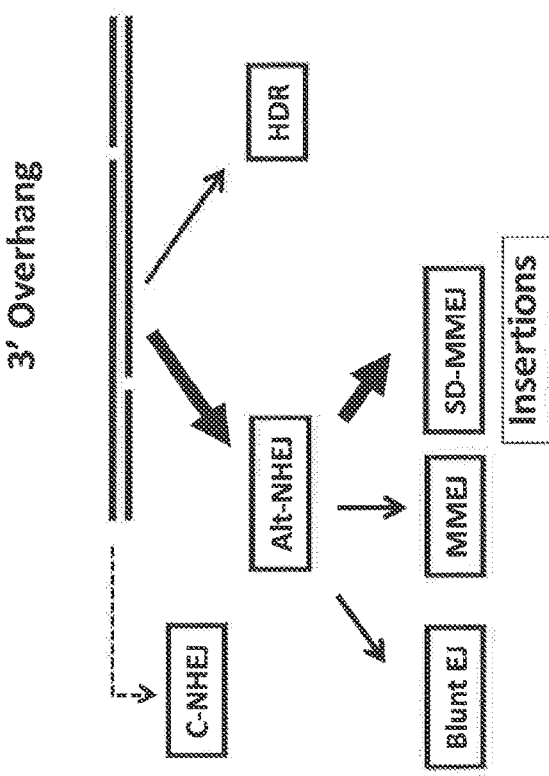
Figure 9: DSBs generated by N863A Cas9 mutant are predominantly repaired by Alt-NHEJ

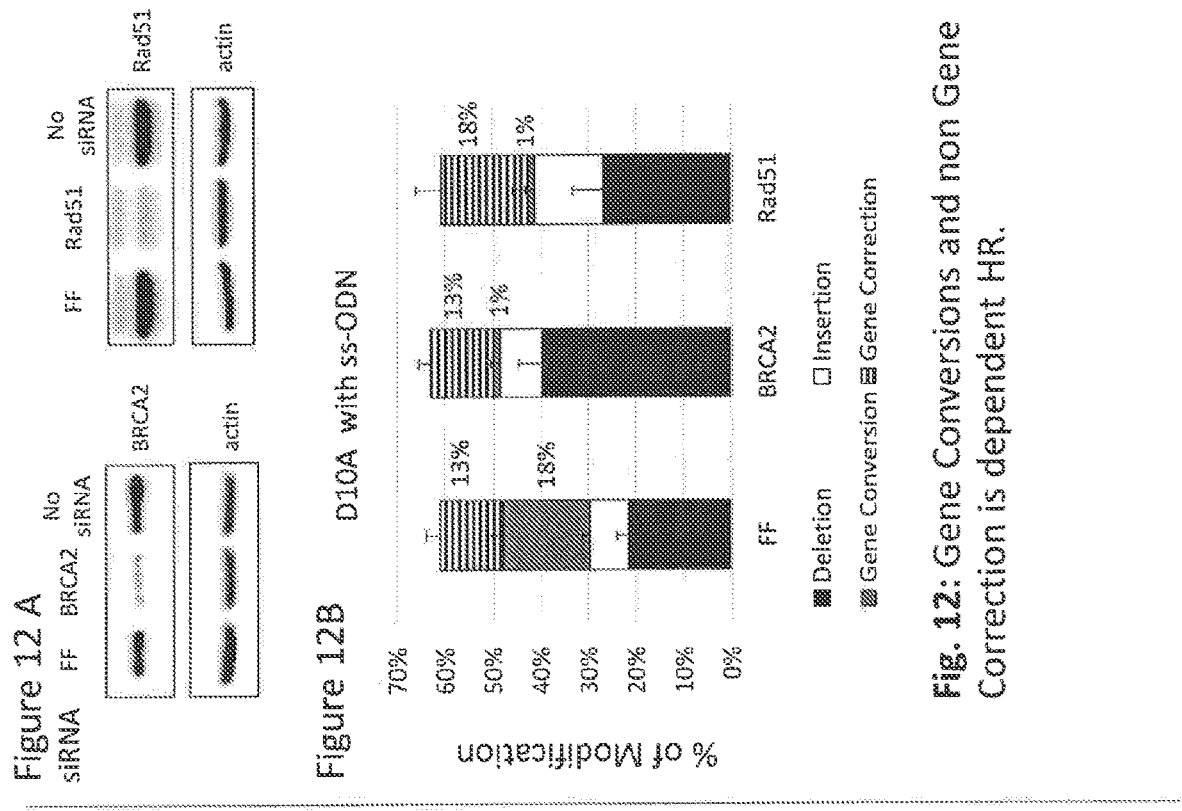
Fig. 12: Gene Conversions and non Gene Correction is dependent HR.
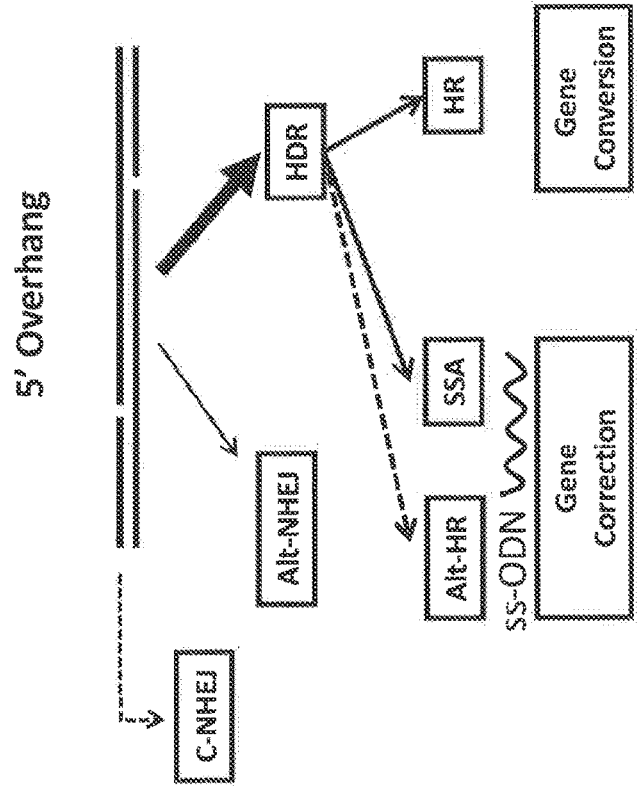
Figure 11: DSBs generated by D10A Cas9 mutant are predominantly repaired by HR Figure 13: Gene Correction is dependent on SSA

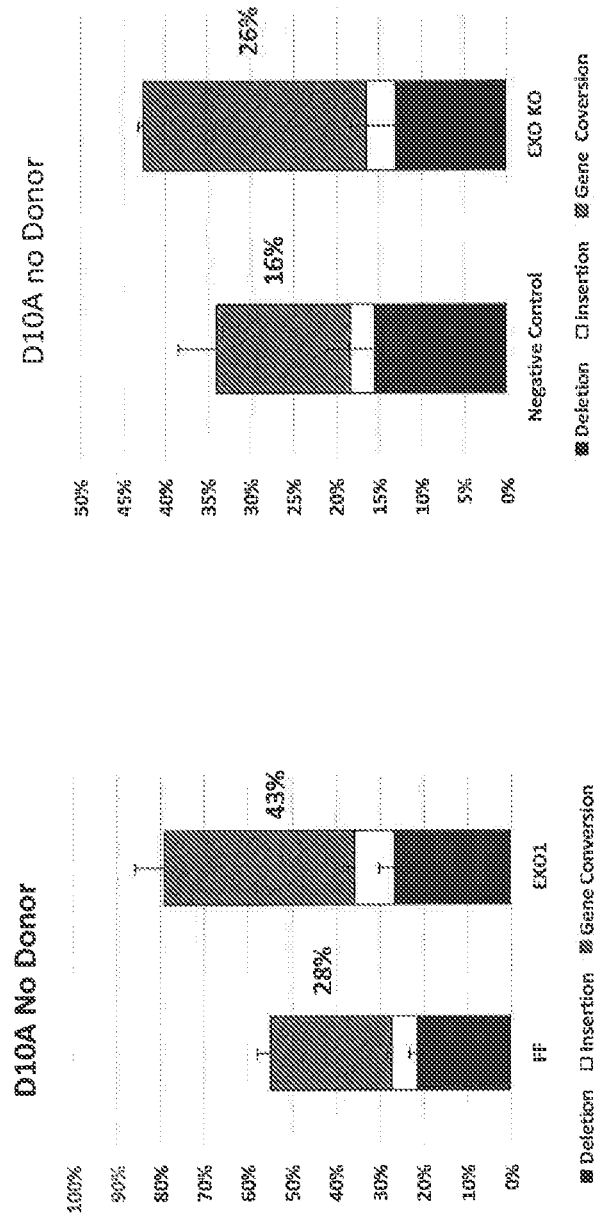
Figure 14: Gene Conversion is dependent on EXO1

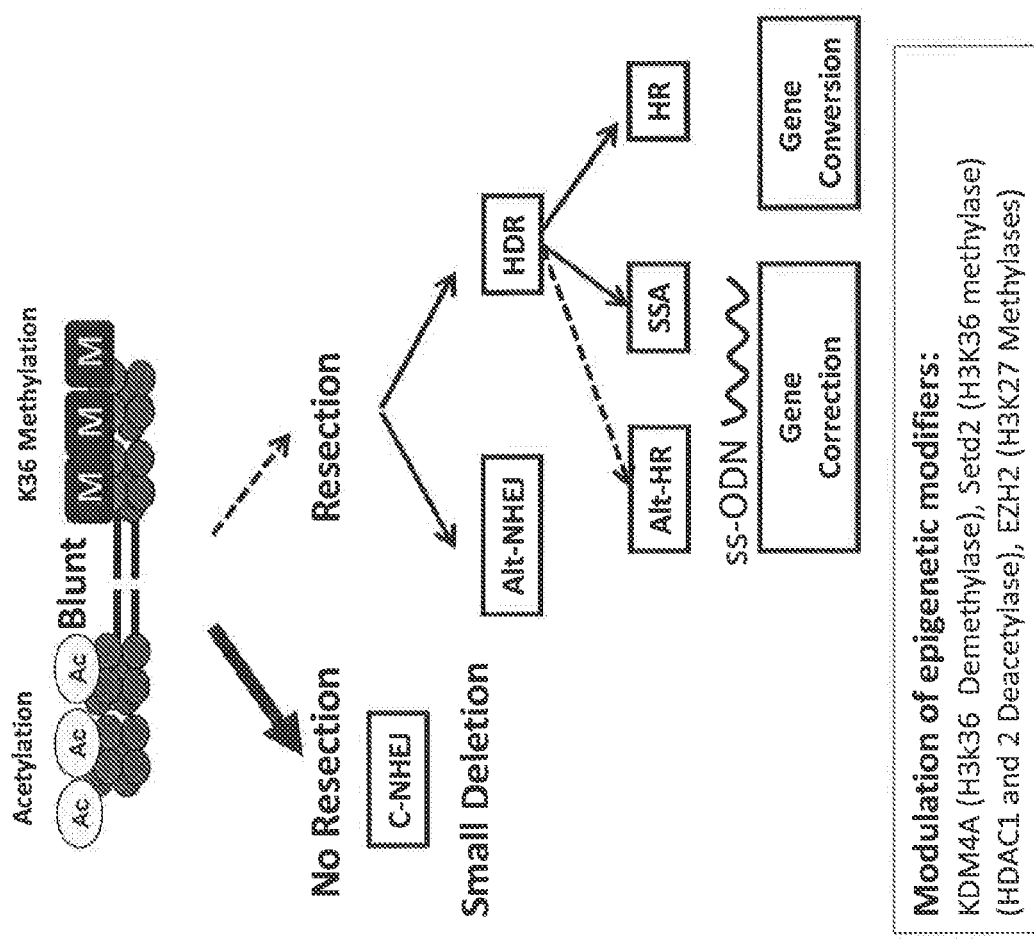
Figure 15: Inhibition of chromatin modification know to promote c-NHEJ in response to DSB in order to increase HDR

METHODS FOR IMPROVING CRISPR/CAS-MEDIATED GENOME-EDITING

RELATED APPLICATIONS

This application is a national stage application, filed under 35 U.S.C. § 371, of International Application No. PCT/US2015/059782, filed on Nov. 9, 2015, which claims the benefit of U.S. Provisional Patent Application No. 62/077,084, filed on Nov. 7, 2014, and of U.S. Provisional Patent Application No. 62/232,683, filed Sep. 25, 2015. The entire contents of each of the foregoing applications are expressly incorporated herein by reference.

SEQUENCE LISTING

The instant application contains a Sequence Listing which has been submitted electronically in ASCII format and is hereby incorporated by reference in its entirety. Said ASCII copy, created on May 5, 2017, is named 126454_00103_ST25.txt and is 2,654,264 bytes in size.

BACKGROUND

The CRISPR (Clustered Regularly Interspaced Short Palindromic Repeats)/Cas (CRISPR-associated) system evolved in bacteria and archaea as an adaptive immune system to defend against viral attack. Upon exposure to a virus, short segments of viral DNA are integrated into the CRISPR locus. RNA is transcribed from a portion of the CRISPR locus that includes the viral sequence. That RNA, which contains sequence complimentary to the viral genome, mediates targeting of a Cas9 protein to the sequence in the viral genome. The Cas9 protein cleaves and thereby silences the viral target.

Recently, the CRISPR/Cas system has been adapted for genome editing in eukaryotic cells. The introduction of site-specific double strand breaks (DSBs) enables target nucleic acid alteration. After the formation of a DNA double-stranded break (DSB), the major decision point affecting DNA repair pathway choice is whether or not the DNA ends are endo- and exonucleolytically processed in a process referred to as end resection. When no end resection takes places, the repair pathway engaged to repair the DSB is referred to as classical non-homologous end joining (C-NHEJ). The C-NHEJ repair pathway leads to either perfect repair of the DSBs, in which case the locus is restored without sequence alterations, or to the formation of small insertions and deletions.

In contrast, if the end resection machinery processes the DSB, a 3' overhang is exposed, which engages in homology search. A not yet completely characterized class of pathways that can engage the repair of DSBs after resection is initiated is referred to as alternative non-homologous end joining (ALT-NHEJ). Examples of pathways that are categorized as ALT-NHEJ include blunt end-joining (blunt EJ) and microhomology mediated end joining (MMEJ) leading to deletions, as well as synthesis dependent micro homology mediated end joining (SD-MMEJ), leading to the formation of insertions.

When the end resection is extensive, the exposed 3' overhang can undergo strand invasion of highly homologous sequences, followed by repair of the DSB by a homology-dependent recombination (HDR) pathway. The HDR pathway comprises homologous recombination (HR), single strand annealing (SSA), and a potential third, not yet fully characterized alternative-HR pathway ("alt-HR").

While a cell could, in theory, repair breaks via any of a number of DNA damage repair pathways, in certain circumstances it is particularly useful to provide an environment more favorable for repair of the break by a HDR pathway. However, there remains a need to improve the efficiency of HDR-mediated modification in order to broaden the applicability of genome editing by the CRISPR/Cas system.

SUMMARY

This disclosure provides systems and methods for editing a genome using a CRISPR/Cas system which enables target nucleic acid alteration by homology-directed repair (HDR) pathways. In HDR, a cell repairs a damaged region by using a homologous template. In normal cells, this template is often a sister chromatid. To encourage the cell to repair a break by HDR, one can provide an exogenous template nucleic acid that bears, for example, the "correct" sequence corresponding to a mutation. To even further increase the likelihood that the cell repairs the break using HDR, one can contact the cell with an HDR-enhancer. Some HDR-enhancers are agents that inhibit another DNA damage repair pathway, with the result that the cell becomes more likely to use a HDR pathway than the inhibited DNA damage repair pathway. Other HDR-enhancers directly stimulate a HDR pathway. In another embodiment, to encourage the cell to repair a break by HDR, one can optimize the DNA cut. For example, dual gRNAs can be designed to be oriented on a target nucleic acid such that the protospacer adjacent motifs (PAMs) are facing out, and cutting with a Cas9 nickase molecule will result in 5' overhangs.

In one aspect, described herein is a Cas9 system comprising a gRNA molecule capable of targeting a Cas9 molecule to a target nucleic acid in a cell, a Cas9 molecule, and an HDR-enhancer molecule. In one embodiment, described herein is a Cas9 system comprising an HDR-enhancer molecule and a gRNA molecule. In another embodiment, described herein is a Cas9 system comprising an HDR-enhancer molecule and a Cas9 molecule. In one embodiment, the HDR-enhancer molecule is not an inhibitor of DNA-PK. In one embodiment, the HDR-enhancer molecule is not an inhibitor of Ligase IV.

In one embodiment, the HDR-enhancer molecule is an HDR-enhancing gRNA. In another embodiment, the HDR-enhancer molecule is an siRNA. In another embodiment, the HDR-enhancer molecule is an antibody. In another embodiment, the HDR-enhancer molecule is an miRNA. In another embodiment, the HDR-enhancer molecule is an antiMiR. In another embodiment, the HDR-enhancer molecule is a small molecule. In another embodiment, the HDR-enhancer molecule is a protein. In one embodiment, the protein is a dominant negative protein.

In one embodiment, the HDR-enhancer is a down-regulator of HR, a down-regulator of canonical NHEJ, a down-regulator of alt-NHEJ, a down-regulator of an antirecombinant factor, a down-regulator of SSA, a down-regulator of SSBR, a down-regulator of MMR, a chromatin modification agent, a cell cycle arrest compound, an agent capable of promoting resection at a double strand break, a down-regulator of SD-MMEJ, or a down-regulator of blunt EJ.

In one embodiment, the Cas9 system further comprises a template nucleic acid. In one embodiment, the template nucleic acid is an endogenous nucleic acid in a cell.

In one embodiment, the Cas9 system further comprises a second gRNA suitable for targeting a Cas9 molecule to the target nucleic acid, or a second nucleic acid encoding a second gRNA suitable for targeting a Cas9 molecule to the target nucleic acid. In one embodiment, the Cas9 system further comprises a second gRNA or a second nucleic acid encoding a second gRNA. In one embodiment, the gRNA is configured to guide the Cas9 molecule to produce a first break, and the second gRNA is configured to guide a second Cas9 molecule to produce a second break. In another embodiment, the gRNA and the second gRNA are configured to position the first break and the second break within 65 nucleotides of one another; at least 25 nucleotides apart; or within 25-65 nucleotides of one another.

In another aspect, described herein is a Cas9 system comprising a Cas9 nickase molecule, a gRNA molecule, wherein the gRNA molecule is capable of targeting the Cas9 nickase molecule to a target nucleic acid, and a second gRNA molecule, wherein the second gRNA molecule is capable of targeting the Cas9 nickase molecule to the target nucleic acid, wherein the gRNA molecule and the second gRNA molecule are designed to be oriented on the target nucleic acid such that protospacer adjacent motifs (PAMs) are facing out, wherein the gRNA molecule will position the Cas9 nickase molecule to make a single-stranded break in the target nucleic acid which results a 5' overhang in the target nucleic acid. In one embodiment, the Cas9 nickase molecule has a D10A mutation. In another embodiment, the gRNA molecule will position the Cas9 nickase molecule to make a single-stranded break in the target nucleic acid which results in a 3' overhang in the target nucleic acid.

In another aspect, described herein is a Cas9 system comprising a Cas9 nickase molecule, a gRNA molecule, wherein the gRNA molecule is capable of targeting the Cas9 nickase molecule to a target nucleic acid, and a second gRNA molecule, wherein the second gRNA molecule is capable of targeting the Cas9 nickase molecule to the target nucleic acid, wherein the gRNA molecule and the second gRNA molecule are designed to be oriented on the target nucleic acid such that protospacer adjacent motifs (PAMs) are facing out, wherein the gRNA molecule will position the Cas9 nickase molecule to make a single-stranded break in the target nucleic acid which results a 3' overhang in the target nucleic acid. In one embodiment, the Cas9 nickase molecule has an N863A mutation.

In one embodiment, the Cas9 system comprises a gRNA. In one embodiment, the Cas9 system comprises a nucleic acid encoding a gRNA. In one embodiment, the Cas9 system comprises both a gRNA and a nucleic acid encoding a gRNA.

In on embodiment, the Cas9 system comprises a second gRNA. In one embodiment, the Cas9 system comprises a second nucleic acid encoding a second gRNA. In another embodiment, the Cas9 system comprises both a second gRNA and a nucleic acid encoding a second gRNA.

In one embodiment, the Cas9 system comprises a Cas9 polypeptide. In one embodiment, the Cas9 system comprises a nucleic acid encoding a Cas9 polypeptide. In one embodiment, the Cas9 system comprises both a Cas9 polypeptide and a nucleic acid encoding a Cas9 polypeptide.

In one embodiment, the Cas9 system comprises an HDR-enhancer. In one embodiment, the Cas9 system comprises a nucleic acid encoding an HDR-enhancer. In one embodiment, the Cas9 system comprises both an HDR-enhancer and a nucleic acid encoding an HDR-enhancer.

In one embodiment, the Cas9 system comprises a gRNA, a Cas9 polypeptide, and an HDR-enhancer. In another embodiment, the Cas9 system comprises a nucleic acid encoding a gRNA, a nucleic acid encoding a Cas9 polypeptide, and a nucleic acid encoding an HDR-enhancer. In another embodiment, the Cas9 system comprises a nucleic acid encoding a gRNA, a Cas9 polypeptide, and an HDR-enhancer. In another embodiment, the Cas9 system comprises a nucleic acid encoding a gRNA, a nucleic acid encoding a Cas9 polypeptide, and an HDR-enhancer. In another embodiment, the Cas9 system comprises a gRNA, a nucleic acid encoding a Cas9 polypeptide, and an HDR-enhancer. In another embodiment, the Cas9 system comprises a gRNA, a Cas9 polypeptide, and a nucleic acid encoding an HDR-enhancer. In another embodiment, the composition comprises a gRNA, a nucleic acid encoding a Cas9 polypeptide, and a nucleic acid encoding an HDR-enhancer. In one embodiment, the Cas9 system further comprises a template nucleic acid.

In one embodiment, the HDR-enhancer molecule is an antibody, an miRNA, an siRNA, an antiMiR, a small molecule, or an HDR-enhancing gRNA. In one embodiment, the HDR-enhancer molecule is an miRNA. In one embodiment, the HDR-enhancer molecule is an siRNA. In one embodiment, the HDR-enhancer molecule is an antiMiR. In one embodiment, the HDR-enhancer molecule is an HDR-enhancing gRNA. In one embodiment, the HDR-enhancer molecule is a small molecule. In one embodiment, the HDR-enhancer molecule is an antibody. In one embodiment, the antibody is an intrabody. In one embodiment, the antibody comprises a nuclear localization sequence. In one embodiment, the siRNA is an siRNA comprising a modified nucleotide. In one embodiment, the siRNA is directed against an mRNA that encodes a target.

In one embodiment, the HDR-enhancer molecule is not an inhibitor of RAD51. In one embodiment, the HDR-enhancer molecule is not an inhibitor of BRCA2. In one embodiment, the HDR-enhancer molecule is not an inhibitor of PALB2. In one embodiment, the HDR-enhancer molecule is not an inhibitor of SHFM1. In one embodiment, the HDR-enhancer molecule is not an inhibitor of Ku70. In one embodiment, the HDR-enhancer molecule is not an inhibitor of Ku80. In one embodiment, the HDR-enhancer molecule is not an inhibitor of DNA-PKcs. In one embodiment, the HDR-enhancer molecule is not an inhibitor of XRCC4. In one embodiment, the HDR-enhancer molecule is not an inhibitor of XLF. In one embodiment, the HDR-enhancer molecule is not an inhibitor of Ligase IV. In one embodiment, the HDR-enhancer molecule is not an inhibitor of PNK. In one embodiment, the HDR-enhancer molecule is not an inhibitor of Artemis. In one embodiment, the HDR-enhancer molecule is not PARP1. In one embodiment, the HDR-enhancer molecule is not PARP2. In one embodiment, the HDR-enhancer molecule is not XRCC1. In one embodiment, the HDR-enhancer molecule is not Ligase III. In one embodiment, the HDR-enhancer molecule is not Histone H1.

In one embodiment, the HDR-enhancer molecule is a down-regulator of anti-HR. In one embodiment, the down-regulator of anti-HR is an inhibitor of a protein which inhibits HR or promotes repression of HR. In one embodiment, the down-regulator of anti-HR is capable of promoting SSA or alt-HR. In one embodiment, the down-regulator of anti-HR is capable of promoting SSA or alt-HR as compared to the level of SSA or alt-HR in the absence of the down-regulator of anti-HR.

In one embodiment, the HDR-enhancer molecule is an inhibitor of a component of Table VI.4 or Table VI.1(D). In one embodiment, the HDR-enhancer molecule is an antibody. In one embodiment, the antibody is an intrabody. In one embodiment, the HDR-enhancer molecule is an siRNA. In one embodiment, the HDR-enhancer molecule is an HDR-enhancing gRNA.

In one embodiment, the antibody, the siRNA, or the HDR-enhancing gRNA is directed against a component from Table VI.4 or Table VI.1(D). In one embodiment, the HDR-enhancer molecule is an agent of Table VI.5. In one embodiment, the HDR-enhancer inhibits Fbh1, PARI, RTEL, Rap80, miR-155, miR-545, miR-107, miR-1255, miR-148, or miR-193. In one embodiment, the HDR-enhancer that inhibits Fbh1 is an siRNA. In one embodiment, the HDR enhancer that inhibits PARI is an siRNA. In one embodiment, the HDR-enhancer that inhibits RTEL is an siRNA. In one embodiment, the HDR-enhancer that inhibits RAP80 is an siRNA. In one embodiment, the HDR-enhancer that inhibits miR-155, miR-545, miR-107, miR-1255, miR-148, or miR-193 is an anti-miR. In another embodiment, the HDR-enhancer is an HDR-enhancing gRNA molecule.

In one embodiment, the HDR-enhancer molecule is a down-regulator of SSA. In one embodiment, the down-regulator of SSA is an inhibitor of a protein, wherein the protein promotes SSA. In one embodiment, the down-regulator of SSA is capable of promoting HR or alt-HR. In one embodiment, the down-regulator of SSA is capable of promoting HR or alt-HR as compared to the level of HR or alt-HR that would occur in the absence of the down-regulator of SSA.

In one embodiment, the HDR-enhancer molecule is an inhibitor of a component of Table VI.1(E) or VI.11. In one embodiment, the HDR-enhancer molecule is an antibody, an siRNA, a small molecule, or an HDR-enhancing gRNA. In one embodiment, the antibody is an intrabody.

In one embodiment, the antibody, the siRNA, or the HDR-enhancing gRNA is directed against a component from Table VI.1(E) or VI.11. In one embodiment, the HDR-enhancer molecule is an agent of Table VI.12.

In one embodiment, the HDR-enhancer molecule inhibits Rad52, XPF, or ERCC1. In one embodiment, the HDR-enhancer molecule that inhibits Rad52, XPF or ERCC1 is an siRNA or an HDR-enhancing gRNA molecule.

In one embodiment, the HDR-enhancer molecule is a chromatin modification agent. In one embodiment, the chromatin modification agent is an agent that inhibits a chromatin modification protein that promotes a DNA repair pathway. In one embodiment, the chromatin modification agent is capable of promoting HDR. In one embodiment, HDR is increased as compared to the level of HDR that would occur in the absence of the chromatin modification agent.

In one embodiment, the chromatin modification agent is not an HDAC. In another embodiment, the HDR-enhancer molecule is an HDAC. In one embodiment, the HDAC is HDAC1 or HDAC2. In one embodiment, the HDR-enhancer that inhibits the HDAC is TCA.

In one embodiment, the HDR-enhancer molecule is present in an amount sufficient to alter chromatin at a target nucleic acid. In one embodiment, the HDR-enhancer molecule is a modulator of a component of Table VI.1(I). In one embodiment, the modulator is an inhibitor. In one embodiment, the HDR-enhancer molecule is an antibody, an siRNA, or a HDR-enhancing gRNA. In one embodiment, the antibody is an intrabody. In one embodiment, the HDR-enhancer molecule is directed against a component from Table VI.1(I). In one embodiment, the HDR-enhancer molecule is an agent of Table VII. In one embodiment, the HDR-enhancer inhibits EZH2. In one embodiment, the HDR-enhancer that inhibits EZH2 is EPZ-6438. In one embodiment, the HDR-enhancer is directed against a component from Table VI.1(I). In one embodiment, the HDR-enhancer is an agent of TableVII. In one embodiment, the HDR-enhancer inhibits Setd2.

In one embodiment, the HDR-enhancer molecule is a down-regulator of SSBR. In one embodiment, the down-regulator of SSBR is an inhibitor of a protein, wherein the protein promotes SSBR. In one embodiment, HDR is increased as compared to the level of HDR that would occur in the absence of the down-regulator of SSBR.

In one embodiment, the HDR-enhancer molecule is an antibody, an siRNA, a small molecule, or an HDR-enhancing gRNA. In one embodiment, the antibody is an intrabody. In one embodiment, the HDR-enhancer molecule is an inhibitor of a component of Table VI.13 or VI.1(F). In one embodiment, the antibody, the siRNA, or the HDR-enhancing gRNA is directed against a component from Table VI.13 or VI.1(F). In one embodiment, the HDR-enhancer molecule is an agent of Table VI.14. In one embodiment, the HDR-enhancer inhibits a PARP or XRCC1. In one embodiment, the HDR-enhancer that inhibits a PARP is selected from the group consisting of AZD2281, KU-0059436, and BMN673. In one embodiment, the HDR-enhancer that inhibits XRCC1 is an siRNA.

In one embodiment, the HDR-enhancer molecule is an agent capable of promoting resection at a single or double strand break. In one embodiment, the agent capable of promoting resection is increases HDR as compared to the level of HDR that would occur in the absence of the agent capable of promoting resection. In one embodiment, the agent that promotes resection at a single or double strand break is an endonuclease or an exonuclease. In one embodiment, the agent that promotes resection is an inhibitor of an anti-resection protein.

In one embodiment, the HDR-enhancer molecule is an antibody, an siRNA, a small molecule, a polypeptide, or an HDR-enhancing gRNA. In one embodiment, the antibody is an intrabody. In one embodiment, the anti-resection protein is a protein of Table VI.1(A). In one embodiment, the antibody, the siRNA, or the HDR-enhancing gRNA is directed against a component from Table VI.1(A). In one embodiment, the inhibitor of an anti-resection protein is an inhibitor of 53BP1, Rif-1, or PTIP. In one embodiment, the inhibitor of an anti-resection protein is a dominant negative 53BP1 protein.

In one embodiment, the HDR-enhancer molecule is a down-regulator of SD-MMEJ. In one embodiment, the HDR-enhancer molecule is an antibody, an siRNA, or a an HDR-enhancing gRNA. In one embodiment, the antibody is an intrabody. In one embodiment, the HDR-enhancer molecule is an inhibitor of Pol Theta. In one embodiment, the HDR-enhancer molecule is a CDK1 inhibitor. In one embodiment, the HDR-enhancer molecule is an agent of Table VIII. In one embodiment, the antibody, the siRNA, or the HDR-enhancing gRNA is directed against a component from Table VIII.

In one embodiment, the HDR-enhancer molecule is an agent that promotes cell cycle arrest in G2 phase, wherein the HDR-enhancer molecule is not a CDK1 inhibitor. In one embodiment, the HDR-enhancer molecule is present in an amount sufficient to cause a cell to arrest in G2 phase.

In one embodiment, the Cas9 system further comprises an additional one or more HDR-enhancer molecules. In one embodiment, the Cas9 system further comprises an additional one HDR enhancer molecule. In one embodiment, the Cas9 system further comprises an additional two HDR-enhancer molecules.

In one embodiment, the HDR-enhancer molecule and the additional one or more HDR-enhancer molecules are capable of up-regulating the same pathway. In one embodiment, the HDR-enhancer molecule and the additional one or more HDR-enhancer molecules are capable of down-regulating the same pathway.

In one embodiment, the HDR-enhancer molecule is a down-regulator of C-NHEJ. In one embodiment, the down-regulator of C-NHEJ is capable of increasing levels of HDR as compared to the level of HDR that would occur in the absence of the down-regulator of C-NHEJ. In one embodiment, the HDR-enhancer molecule is an antibody, an siRNA, a small molecule, or an HDR-enhancing gRNA.

In one embodiment, the HDR-enhancer molecule is an inhibitor of a component of Table VI.7 or VI.1(B). In one embodiment, the antibody, the siRNA, or the HDR-enhancing gRNA is directed against a component from Table VI.7 or VI.1(B). In one embodiment, the HDR-enhancer molecule is an agent of Table VI.8. In one embodiment, the HDR-enhancer molecule is an inhibitor of DNA Pk or an inhibitor of 53BP1. In one embodiment, the inhibitor of DNA Pk is selected from the group consisting of NU7441, KU-0060648, CC115, and NK314. In one embodiment, the inhibitor of 53BP1 is an siRNA targeting 53BP1. In one embodiment, the inhibitor of an anti-resection protein is a dominant negative 53BP1 protein.

In one embodiment, the HDR-enhancer molecule is a down-regulator of blunt EJ. In one embodiment, the HDR-enhancer molecule is a down-regulator of SD-MMEJ. In one embodiment, the down-regulator of blunt EJ or MMEJ is capable of increasing the level of HDR as compared to the level of HDR that would occur in the absence of the down-regulator of blunt EJ or SD-MMEJ. In one embodiment, the HDR-enhancer molecule is an antibody, an siRNA, a small molecule, or an HDR-enhancing gRNA.

In one embodiment, the HDR-enhancer molecule is an inhibitor of a component of Table VI.9 or Table VI.1(J). In one embodiment, the antibody, the siRNA, or the HDR-enhancing gRNA is directed against a component from Table VI.9 or Table VI.1(J). In one embodiment, the HDR-enhancer molecule is an agent of Table VI.10.

In one embodiment, the HDR-enhancer molecule is an up-regulator of HDR. In one embodiment, the up-regulator of HDR is a protein selected from the group consisting of: MRE11, RAD50, NBS1, BRCA2, and BRCA1, or a polypeptide comprising at least 60, 70, 80, 90, 95, 98, 99 or 100% homology with, or which differing by no more than 50, 40, 30, 20, 15, 10, 5, 4, 3, 2, or 1, amino acid residues from a naturally occurring MRE11, RAD50, NBS1, BRCA2, or BRCA1. In one embodiment, the up-regulator of HDR is a protein of Table VI.2 or a protein of Table VI.1(C). In one embodiment, the up-regulator of HDR is a polypeptide comprising at least 60, 70, 80, 90, 95, 98, 99 or 100% homology with, or which differing by no more than 50, 40, 30, 20, 15, 10, 5, 4, 3, 2, or 1, amino acid residues from, a protein of Table VI.2 or Table VI.1(C). In another embodiment, the up-regulator of HDR is a dominant negative CtIP. A dominant negative CtIP promotes resection in G1 phase.

In another embodiment, the HDR-enhancer molecule is an up-regulator of SSA. In one embodiment, the up-regulator of SSA is a protein selected from the group consisting of Rad52 and ERCC1. In one embodiment, the up-regulator of SSA is a polypeptide comprising at least 60, 70, 80, 90, 95, 98, 99 or 100% homology with, or which differing by no more than 50, 40, 30, 20, 15, 10, 5, 4, 3, 2, or 1, amino acid residues from, Rad52 or ERCC1.

In one embodiment, the HDR-enhancer molecule is a down-regulator of one HDR pathway. In one embodiment, the down-regulator one HDR Pathway is an inhibitor of a protein, wherein the protein promotes other HDR pathways. In one embodiment, the down-regulator of HDR is capable of increasing alt-HR and/or SSA as compared to the level of alt-HR and/or SSA in the absence of the down-regulator of HDR. In one embodiment, the down-regulator of HDR is capable of increasing alt-HR and/or HR as compared to the level of alt-HR and/or HR in the absence of the down-regulator of HDR. In one embodiment, the down-regulator of HDR is capable of increasing HR and/or SSA as compared to the level of HR and/or SSA in the absence of the down-regulator of -HDR.

In one embodiment, the HDR-enhancer molecule is an inhibitor of a component of Table VI.2 or VI.1(C). In one embodiment, the HDR-enhancer molecule is an antibody, an siRNA, a small molecule, or an HDR-enhancing gRNA. In one embodiment, the antibody is an intrabody. In one embodiment, the antibody, the siRNA, the small molecule, or the HDR-enhancing gRNA is directed against a component from Table VI.2 or VI.1(C). In one embodiment, the HDR-enhancer molecule is an agent of Table VI.3.

In one embodiment, the HDR-enhancer inhibits BRCA2, BRCA1, or RAD51. In one embodiment, the HDR-enhancer molecule is an antibody directed against a BRCA2, BRCA1, or RAD51. In one embodiment, the antibody is an intrabody. In one embodiment, the HDR-enhancer molecule is an siRNA directed against BRCA2, BRCA1, or RAD51. In one embodiment, the HDR-enhancer molecule is selected from: B02, A03, AI-10, RI-1, RI-2, and IBR2.

In one embodiment, the HDR-enhancer molecule is a cell cycle arrest agent. In one embodiment, the Cas9 system of further comprises a cell cycle arrest agent. In one embodiment, the cell cycle arrest agent is capable of arresting cells in G2 phase. In one embodiment, the cell cycle arrest agent is a Cdk1 inhibitor. In one embodiment, the Cdk1 inhibitor is an siRNA or an antibody. In one embodiment, the cell cycle arrest agent is not a Cdk1 inhibitor.

In one embodiment, the gRNA is configured to position a Cas9 molecule-mediated cleavage event at a preselected position relative to a landmark on a target nucleic acid, wherein the target nucleic acid is an endogenous nucleic acid. In one embodiment, the landmark is a preselected site in the target nucleic acid. In another embodiment, the preselected position, or the landmark, or both the preselected position and the landmark, are present on the endogenous nucleic acid. In one embodiment, the endogenous nucleic acid is a chromosomal nucleic acid or an organellar nucleic acid. In one embodiment, the endogenous nucleic acid is not a heterologous reporter gene.

In one embodiment, the gRNA comprises at least one domain of a preselected length. In another embodiment, the at least one domain is a targeting domain.

In one embodiment, the landmark is a target position, wherein the target position is the nucleotide or one of the nucleotides to be corrected or altered. In one embodiment, the landmark is the 5' end of a target position, wherein the target position is a nucleotide or one of the nucleotides to be corrected or altered. In one embodiment, the landmark is the 3' end of a target position, wherein the target position is the nucleotide or one of the nucleotides to be corrected or altered. In one embodiment, the landmark is within a target position, wherein the target position is the nucleotide or one of the nucleotides to be corrected or altered.

In one embodiment, the Cas9 system further comprises a template nucleic acid comprising a 5' homology arm, a replacement sequence, and a 3' homology arm, wherein the landmark is a position on the target nucleic acid that corresponds to the 5' end of the replacement sequence.

In one embodiment, the Cas9 system further comprises a template nucleic acid comprising a 5' homology arm, a replacement sequence, and a 3' homology arm, wherein the landmark is a position on the target nucleic acid that corresponds to the 3' end of the replacement sequence.

In one embodiment, the Cas9 system further comprises a template nucleic acid comprising a 5' homology arm, a replacement sequence, and a 3' homology arm, wherein the landmark is a position on the target nucleic acid within the replacement sequence.

In one embodiment, the Cas9 system further comprises a template nucleic acid comprising a 5' homology arm, a replacement sequence, and a 3' homology arm, wherein the landmark is a position on the target nucleic acid within the 5' homology arm.

In one embodiment, the Cas9 system further comprises a template nucleic acid comprising a 5' homology arm, a replacement sequence, and a 3' homology arm, wherein the landmark is a position on the target nucleic acid within the 3' homology arm.

In one embodiment, the Cas9 system further comprises a template nucleic acid comprising a 5' homology arm, a replacement sequence, and a 3' homology arm, wherein the landmark is a position on the target nucleic acid that corresponds to the 5' end of the template nucleic acid.

In one embodiment, the Cas9 system further comprises a template nucleic acid comprising a 5' homology arm, a replacement sequence, and a 3' homology arm, wherein the landmark is a position on the target nucleic acid that corresponds to the 3' end of the template nucleic acid.

In one embodiment, the landmark is an intron/exon boundary. In one embodiment, the intron/exon boundary is the intron/exon boundary nearest a target position, wherein the target position is a nucleotide or one of the nucleotides to be corrected or altered. In one embodiment, the intron/exon boundary is within 50, 100, 200, or 500 nucleotides of the target position, wherein the target position is a nucleotide or one of the nucleotides to be corrected or altered.

In one embodiment, the landmark is in an intron. In one embodiment, the intron is the intron nearest to a target position, wherein the target position is a nucleotide or one of the nucleotides to be corrected or altered. In one embodiment, the intron is the nearest intron upstream of a target position, wherein the target position is a nucleotide or one of the nucleotides to be corrected or altered. In one embodiment, the intron is the nearest intron downstream of a target position, wherein the target position is a nucleotide or one of the nucleotides to be corrected or altered. In one embodiment, the intron is an intron within 50, 100, 200, or 500 nucleotides of the target position.

In one embodiment, the landmark is in an exon. In one embodiment, the exon is the exon nearest to a target position, wherein the target position is a nucleotide or one of the nucleotides to be corrected or altered. In one embodiment, the exon is the nearest exon upstream of a target position, wherein the target position is a nucleotide or one of the nucleotides to be corrected or altered. In one embodiment, the exon is the nearest exon downstream of a target position, wherein the target position is a nucleotide or one of the nucleotides to be corrected or altered. In one embodiment, the exon is an exon within 50, 100, 200, or 500 nucleotides of the target position.

In one embodiment, the landmark is the 5' end of a coding region or the 3' end of a coding region. In one embodiment, the coding region is the coding region nearest to a target position. In one embodiment, the coding region is the coding region within a target position lies. In one embodiment, the coding region is the nearest coding region downstream of a target position. In one embodiment, the coding region is the nearest coding region upstream of a target position. In one embodiment, the coding region is a coding region within 50, 100, 200, or 500 nucleotides of a target position. In one embodiment, the landmark is within a coding region. In one embodiment, the coding region is the coding region nearest to a target position. In one embodiment, the coding region is the coding region within which a target position lies. In one embodiment, the coding region is the nearest coding region upstream of a target position, or the nearest coding region downstream of a target position. In one embodiment, the coding region is a coding region within 50, 100, 200, or 500 nucleotides of a target position.

In one embodiment, the landmark is the 5' end of a transcribed region. In one embodiment, the transcribed region is a transcribed region nearest to a target position, a transcribed region within which a target position lies, a nearest transcribed region upstream of a target position, a nearest transcribed region downstream of a target position, or a transcribed region within 50, 100, 200, or 500 nucleotides of a target position.

In one embodiment, the landmark is the 3' end of a transcribed region. In one embodiment, the transcribed region is a transcribed region nearest to a target position, a transcribed region within which a target position lies, a nearest transcribed region upstream of a target position, a nearest transcribed region downstream of a target position, or a transcribed region within 50, 100, 200, or 500 nucleotides of a target position.

In one embodiment, the landmark is within a transcribed region. In one embodiment, the transcribed region is a transcribed region nearest to a target position, a transcribed region within which a target position lies, a nearest transcribed region upstream of a target position, a nearest transcribed region downstream of a target position, or a transcribed region within 50, 100, 200, or 500 nucleotides of a target position.

In one embodiment, the landmark is the 5' end of a repeated element. In one embodiment, the landmark is the 3' end of a repeated element. In one embodiment, the landmark is within a repeated element. In one embodiment, the repeated element is a repeated element nearest to a target position, a repeated element within which a target position lies, a nearest repeated element upstream of a target position, a nearest repeated element downstream of a target position, or a repeated element within 50, 100, 200, or 500 nucleotides of a target position. In one embodiment, the preselected position is at the landmark, not at the landmark, within 50, 100, 150, or 200 nucleotides of the landmark, at least 10, 20, 30, 40, or 50 nucleotides away from the landmark, or 10-200, 20-200, 30-200, 40-200, 50-200, 10-150, 10-100, or 10-50 nucleotides away from the landmark.

In one embodiment, the landmark is a target position, wherein the target position is a nucleotide or one of the nucleotides to be corrected or altered, and the preselected position is at the landmark, away from the landmark, within 50, 100, 150, or 200 nucleotides of the landmark, or 10-200, 20-200, 30-200, 40-200, 50-200, 10-150, 10-100, or 10-50 nucleotides away from the landmark.

In one embodiment, the landmark is a repetitive sequence, and wherein the preselected position is away from the landmark; at least 50, 100, 150, or 200 nucleotides away from the landmark; or 10-200, 20-200, 30-200, 40-200, 50-200, 10-150, 10-100, or 10-50 nucleotides away from the landmark.

In one embodiment, the targeting domain is 12-30 nucleotides in length. In one embodiment, the targeting domain is at least 21 nucleotides in length.

In one embodiment, the at least one domain of a preselected length is a domain encompassing a proximal domain and a tail domain which, taken together, are at least 15, 18, 20, 25, 30, 31, 35, 40, 45, 49, 50, or 53 nucleotides in length.

In one embodiment, the 5' homology arm has a length of at least 50, 100, 250, 500, 750, 1000, 2000, 3000, 4000, or 5000 nucleotides. In one embodiment, the 5' homology arm has a length of no more than 50, 100, 250, 500, 750, 1000, 2000, 3000, 4000, or 5000 nucleotides. In one embodiment, the 5' homology arm has a length of between 50-100, 100-250, 250-500, 500-750, 750-1000, 1000-2000, 2000-3000, 3000-4000, or 4000-5000 nucleotides.

In one embodiment, the 5' homology arm has a length of at least 50, 100, 250, 500, 750, 1000, 2000, 3000, 4000, or 5000 nucleotides. In one embodiment, the 5' homology arm has a length of no more than 50, 100, 250, 500, 750, 1000, 2000, 3000, 4000, or 5000 nucleotides. In one embodiment, the 5' homology arm has a length of between 50-100, 100-250, 250-500, 500-750, 750-1000, 1000-2000, 2000-3000, 3000-4000, or 4000-5000 nucleotides.

In one embodiment, the 5' homology arm has a 5' end and a 3' end and: the 5' end is at least 50, 100, 250, 500, 750, 1000, 2000, 3000, 4000, or 5000 nucleotides from a target position, the 5' end is no more than 50, 100, 250, 500, 750, 1000, 2000, 3000, 4000, or 5000 nucleotides from a target position, the 5' end is between 50-100, 100-250, 250-500, 500-750, 750-1000, 1000-2000, 2000-3000, 3000-4000, or 4000-5000 nucleotides from a target position, the 3' end is at least 50, 100, 250, 500, 750, 1000, 2000, 3000, 4000, or 5000 nucleotides from a target position, the 3' end is no more than 50, 100, 250, 500, 750, 1000, 2000, 3000, 4000, or 5000 nucleotides from a target position, or the 3' end is between 50-100, 100-250, 250-500, 500-750, 750-1000, 1000-2000, 2000-3000, 3000-4000, or 4000-5000 nucleotides from a target position.

In one embodiment, the 3' homology arm has a 5' end and a 3' end and: the 5' end is at least 50, 100, 250, 500, 750, 1000, 2000, 3000, 4000, or 5000 nucleotides from a target position, the 5' end is no more than 50, 100, 250, 500, 750, 1000, 2000, 3000, 4000, or 5000 nucleotides from a target position, the 5' end is between 50-100, 100-250, 250-500, 500-750, 750-1000, 1000-2000, 2000-3000, 3000-4000, or 4000-5000 nucleotides from a target position, the 3' end is at least 50, 100, 250, 500, 750, 1000, 2000, 3000, 4000, or 5000 nucleotides from a target position, the 3' end is no more than 50, 100, 250, 500, 750, 1000, 2000, 3000, 4000, or 5000 nucleotides from a target position, or the 3' end is between 50-100, 100-250, 250-500, 500-750, 750-1000, 1000-2000, 2000-3000, 3000-4000, or 4000-5000 nucleotides from a target position.

In one embodiment, the replacement sequence has a length of: at least 1, 2, 3, 5, 10, 20, 50, 100, 200, 500, 1000, 2000, 300, 4000, or 5000 nucleotides, no more than 2, 3, 5, 10, 20, 50, 100, 200, 500, 1000, 2000, 300, 4000, or 5000 nucleotides, or between 1-3, 1-5, 1-10 10-20, 20-50, 50-100, 100-200, 200-500, 500-1000, 1000-2000, 2000-3000, 3000-4000, or 4000-5000 nucleotides.

In one embodiment, the gRNA is chimeric. In one embodiment, the gRNA is modular. In one embodiment, the gRNA comprises a targeting domain, a first complementary domain, a second complementary domain, and a proximal domain.

In one embodiment, the template nucleic acid comprises a 5' homology arm, a replacement sequence, and a 3' homology arm. In one embodiment, the replacement sequence corresponds to a second endogenous nucleic acid. In one embodiment, the second endogenous nucleic acid is a second chromosomal nucleic acid or a second organellar nucleic acid. In another embodiment, the second endogenous nucleic acid is not a heterologous reporter gene.

In one embodiment, the template nucleic acid comprises, or comprises a part of, a circular nucleic acid. In one embodiment, the circular nucleic acid is a plasmid. In one embodiment, the template nucleic acid is a linear nucleic acid. In one embodiment, the template nucleic acid comprises a double stranded sequence. In one embodiment, the template nucleic acid comprises a single strand oligonucleotide. In one embodiment, the template nucleic acid comprises a single-stranded DNA hybrid. In one embodiment, the template nucleic acid is present in an AAV or an ILDV. In one embodiment, the template nucleic acid is an endogenous nucleic acid sequence.

In one embodiment, the template nucleic acid comprises about 150-200 nucleotides of homology with a target nucleic acid. In one embodiment, the 150-200 nucleotides of homology correspond to one side of a break in the target nucleic acid. In one embodiment, the 150-200 nucleotides of homology correspond to two sides of a break in the target nucleic acid. In one embodiment, the template nucleic acid comprises about 500-2000 nucleotides of homology with a target nucleic acid. In one embodiment, the 500-2000 nucleotides of homology correspond to one side of a break in the target nucleic acid. In one embodiment, the 500-2000 nucleotides of homology correspond to two sides of a break in the target nucleic acid.

In one embodiment, the template nucleic acid has homology to the target nucleic acid on one side of the break. In one embodiment, the template nucleic acid has homology to the target nucleic acid on two sides of the break. In one embodiment, the template nucleic acid comprises a human sequence. In one embodiment, the human sequence is a wild-type human sequence. In one embodiment, the wild-type human sequence corresponds to a mutation at the target nucleic acid. In one embodiment, the template nucleic acid lacks a repeated element. In one embodiment, the repeated element is an Alu sequence or a LINE sequence. In one embodiment, the template nucleic acid comprises a modified nucleic acid.

In one embodiment, the Cas9 molecule is a protein selected from Table III.1. In another embodiment, the Cas9 molecule is not a *S. pyogenes* Cas9 molecule. In one embodiment, the Cas9 molecule is a *S. pyogenes* Cas9 molecule. In another embodiment, the Cas9 molecule is an *S. aureus* Cas9 molecule. In one embodiment, the Cas9 molecule comprises at least 20%, 30%, 40%, 50%, 55%, 60%, 65%, 70%, 75%, 80%, 85%, 90%, 95%, 99%, or 100% homology with, or which differs by no more than 1, 2, 3, 4, 5, 6, 7, 8, 9, 10, 15, 20, 25, 30, 35, 40, 35, 50, 55, 60, 65, 70, 75, 80, 85, 90, 95, 100, 150, 200, 250, 300, 350 or 400, amino acid residues from, an amino acid sequence of a naturally occurring Cas9 molecule. In one embodiment, the naturally occurring Cas9 molecule is a Cas9 molecule described in Table III.1 herein.

In one embodiment, the Cas9 molecule is less than about 1300 amino acids in length. In another embodiment, the Cas9 molecule comprises a heterologous PI domain. In another embodiment, the Cas9 molecule comprises a REC2 deletion, $REC1_{CT}$ deletion, or a $REC1_{SUB}$ deletion, or any combination thereof.

In one embodiment, the Cas9 system further comprises a second Cas9 molecule. In one embodiment, the Cas9 molecule is a nickase, and the second Cas9 molecule is a nickase. In one embodiment, the Cas9 molecule can catalyze a double strand break, and the second Cas9 molecule is a nickase. In one embodiment, the Cas9 molecule is a nickase, and the second Cas9 molecule can catalyze a double strand break. In one embodiment, the Cas9 molecule can catalyze a double strand break, and the second Cas9 molecule can catalyze a double strand break. In one embodiment, the Cas9 molecule and the second Cas9 molecule have the same amino acid sequence, or wherein the Cas9 molecule and the second Cas9 molecule have different amino acid sequences.

In one embodiment, the Cas9 molecule is an eiCas9 molecule.

In one embodiment, the Cas9 molecule is an eaCas9 molecule. In one embodiment, the eaCas9 can catalyze a double strand break in the target nucleic acid. In one embodiment, the eaCas9 molecule comprises N-terminal RuvC-like domain cleavage activity and HNH-like domain cleavage activity. In one embodiment, the eaCas9 molecule can catalyze a single strand break in a target nucleic acid. In one embodiment, the eaCas9 molecule comprises HNH-like domain cleavage activity but has no, or no significant, N-terminal RuvC-like domain cleavage activity. In one embodiment, the eaCas9 molecule is an HNH-like domain nickase. In one embodiment, the eaCas9 molecule comprises a mutation at D10. In one embodiment, the eaCas9 molecule comprises N-terminal RuvC-like domain cleavage activity but has no, or no significant, HNH-like domain cleavage activity. In one embodiment, the eaCas9 molecule is an N-terminal RuvC-like domain nickase. In one embodiment, the eaCas9 molecule comprises a mutation at H840 or N863.

In one embodiment, the Cas9 molecule is less than about 1200, 1100, 1000, 900, or 800 amino acids in length; or between about 800-1300, 900-1200, 900-1100, or 900-1000 amino acids in length.

In one embodiment, the Cas9 recognizes a PAM site other than NGG, a PAM site other than AGG, or an inverted PAM site.

In one embodiment, described herein is a cell comprising a Cas9 system. In one embodiment, the cell is a eukaryotic cell. In another embodiment, the cell is a vertebrate, mammalian, rodent, goat, pig, bird, chicken, turkey, cow, horse, sheep, fish, primate, or human cell. In another embodiment, the cell is a plant cell. In one embodiment, the plant cell is a monocot or a dicot. In one embodiment, the cell is a mammalian cell. In one embodiment, the cell is a human cell. In one embodiment, the cell is a somatic cell, a germ cell, or a prenatal cell. In one embodiment, the cell is a zygotic cell, a blastocyst cell, an embryonic cell, a stem cell, a mitotically competent cell, or a meiotically competent cell. In one embodiment, the cell is not part of a human embryo. In one embodiment, the cell is a somatic cell. In one embodiment, the cell is a T cell, a CD8+ T cell, a CD8+ naïve T cell, a central memory T cell, an effector memory T cell, a CD4+ T cell, a stem cell memory T cell, a helper T cell, a regulatory T cell, a cytotoxic T cell, a natural killer T cell, a Hematopoietic Stem Cell, a long term hematopoietic stem cell, a short term hematopoietic stem cell, a multipotent progenitor cell, a lineage restricted progenitor cell, a lymphoid progenitor cell, a myeloid progenitor cell, a common myeloid progenitor cell, an erythroid progenitor cell, a megakaryocyte erythroid progenitor cell, a retinal cell, a photoreceptor cell, a rod cell, a cone cell, a retinal pigmented epithelium cell, a trabecular meshwork cell, a cochlear hair cell, an outer hair cell, an inner hair cell, a pulmonary epithelial cell, a bronchial epithelial cell, an alveolar epithelial cell, a pulmonary epithelial progenitor cell, a striated muscle cell, a cardiac muscle cell, a muscle satellite cell, a neuron, a neuronal stem cell, a mesenchymal stem cell, an induced pluripotent stem (iPS) cell, an embryonic stem cell, a monocyte, a megakaryocyte, a neutrophil, an eosinophil, a basophil, a mast cell, a reticulocyte, a B cell, e.g., a progenitor B cell, a Pre B cell, a Pro B cell, a memory B cell, a plasma B cell, a gastrointestinal epithelial cell, a biliary epithelial cell, a pancreatic ductal epithelial cell, an intestinal stem cell, a hepatocyte, a liver stellate cell, a Kupffer cell, an osteoblast, an osteoclast, an adipocyte, a preadipocyte, a pancreatic islet cell (e.g., a beta cell, an alpha cell, a delta cell), a pancreatic exocrine cell, a Schwann cell, or an oligodendrocyte. In one embodiment, the cell is a T cell, a Hematopoietic Stem Cell, a retinal cell, a cochlear hair cell, a pulmonary epithelial cell, a muscle cell, a neuron, a mesenchymal stem cell, an induced pluripotent stem (iPS) cell, or an embryonic stem cell.

In one embodiment, described herein is a composition comprising a Cas9 system. In one embodiment, the composition further comprises a pharmaceutically acceptable excipient. In one embodiment, the composition comprises a cell described herein, or a population of cells comprising cells described herein. In one embodiment, when the composition comprises a gRNA molecule and an HDR-enhancer molecule, the gRNA molecule and the HDR-enhancer molecule form part of a single admixture or are provided separately. In another embodiment, when the composition comprises a Cas9 molecule and an HDR-enhancer molecule, the HDR-enhancer molecule and the Cas9 molecule form part of a single admixture or are provided separately. In another embodiment, when the composition comprises a gRNA molecule, a Cas9 molecule, and an HDR-enhancer molecule; the gRNA molecule, the Cas9 molecule, and the HDR-enhancer molecule form part of a single admixture or are provided separately. In another embodiment, when the composition comprises a gRNA molecule, an HDR-enhancer molecule, and a template nucleic acid; the gRNA molecule, the HDR-enhancer molecule, and the template nucleic acid form part of a single admixture or are provided separately. In another embodiment, when the composition comprises a Cas9 molecule, an HDR-enhancer molecule, and a template nucleic acid; the Cas9 molecule, the HDR-enhancer molecule, and the template nucleic acid form part of a single admixture or are provided separately. In another embodiment, when the composition comprises a gRNA molecule, a Cas9 molecule, an HDR-enhancer molecule, and a template nucleic acid; the gRNA molecule, the Cas9 molecule, the HDR-enhancer molecule, and the template nucleic acid form part of a single admixture or are provided separately.

In one embodiment, described herein is a kit comprising a Cas9 system. In one embodiment, the kit further comprises packaging. In one embodiment, the kit further comprises instructions for use to treat a disorder. In one embodiment, the disorder is a disorder caused by a target position in a target nucleic acid.

In one embodiment, the nucleic acid encoding the gRNA suitable for targeting the Cas9 molecule to the target nucleic acid in the cell is a DNA molecule. In one embodiment, the nucleic acid encoding the Cas9 molecule is a DNA molecule. In one embodiment, the nucleic acid that encodes the HDR-enhancer molecule is a DNA molecule. In one embodiment, the template nucleic acid is a DNA molecule.

In one embodiment, the Cas9 system further comprises a nucleic acid that encodes a second gRNA. In one embodiment, the Cas9 system further comprises a nucleic acid that encodes a second Cas9 molecule. In one embodiment, the Cas9 system further comprises a nucleic acid that encodes a second HDR-enhancer. In one embodiment, the Cas9 system further comprises a nucleic acid that encodes a third HDR-enhancer.

In one embodiment, the HDR-enhancer molecule is a protein. In one embodiment, the HDR-enhancer molecule is an RNA molecule. In one embodiment, the nucleic acid that encodes the HDR-enhancer molecule is a DNA molecule.

In one embodiment, the nucleic acid encoding the gRNA and the nucleic acid encoding the Cas9 polypeptide are present on a single nucleic acid molecule. In another embodiment, the nucleic acid encoding the gRNA and the nucleic acid encoding the Cas9 polypeptide are present on separate nucleic acid molecules.

In one embodiment, the nucleic acid encoding the gRNA and the nucleic acid encoding the HDR-enhancer are present on a single nucleic acid molecule. In another embodiment, the nucleic acid encoding the gRNA and the nucleic acid encoding the HDR-enhancer are present on separate nucleic acid molecules. In another embodiment, the nucleic acid encoding the Cas9 polypeptide and the nucleic acid encoding the HDR-enhancer are present on a single nucleic acid molecule. In another embodiment, the nucleic acid encoding the Cas9 polypeptide and the nucleic acid encoding the HDR-enhancer are present on separate nucleic acid molecules. In another embodiment, the nucleic acid encoding the gRNA, the nucleic acid encoding the Cas9 polypeptide, and the nucleic acid encoding the HDR-enhancer are present on a single nucleic acid molecule. In another embodiment, the nucleic acid encoding the gRNA and the nucleic acid encoding the Cas9 polypeptide are present on a single nucleic acid molecule and the nucleic acid encoding the HDR-enhancer is present on a separate nucleic acid molecule. In another embodiment, the nucleic acid encoding the gRNA and the nucleic acid encoding the HDR-enhancer are present on a single nucleic acid molecule and the nucleic acid encoding the Cas9 polypeptide is present on a separate nucleic acid molecule. In another embodiment, the nucleic acid encoding the Cas9 polypeptide and the nucleic acid encoding the HDR-enhancer are present on a single nucleic acid molecule and the nucleic acid encoding the gRNA is present on a separate nucleic acid molecule. In another embodiment, the nucleic acid encoding the gRNA, the nucleic acid encoding the Cas9 polypeptide, and the nucleic acid encoding the HDR-enhancer are each present on separate nucleic acid molecules. In one embodiment, the single nucleic acid molecule is a circular double stranded DNA molecule. In another embodiment, the single nucleic acid molecule is a linear double stranded DNA molecule.

In one embodiment, one or a plurality of components are provided as a single admixture. In another embodiment, one or a plurality of components are each provided separately from one another. In another embodiment, one or a plurality of components are each provided in separate solutions.

In one embodiment, the HDR-enhancer molecule is an HDR-enhancing gRNA, and the Cas9 molecule is an enzymatically inactive Cas9 molecule (eiCas9).

In one embodiment, the HDR-enhancer molecule is an HDR-enhancing gRNA, and the Cas9 molecule is fused to a transcription activator or a transcription repressor. In one embodiment, the Cas9 molecule is an enzymatically inactive Cas9 molecule (eiCas9). In another embodiment, the Cas9 molecule is an enzymatically active Cas9 molecule (eaCas9).

In one embodiment, the HDR-enhancing gRNA targets the Cas9 molecule to a gene selected from the group consisting of TP53BP1, RIF1, PAXIP1, XRCC6, XRCC5, PRKDC, LIG4, XRCC4, NHEJ1, DCLRE1C, BRCA2, RAD51, XRCC1, LIG1, LIG3, POLQ, FBXO18, RTEL1, PARPBP, UIMC1, RAD52, ERCC1, ERCC4, PARP1, BRCA1, RBBP8, EXO1, DNA2, MRE11A, RAD50, NBN, MSH2, MSH3, MSH6, M1H1, PMS2, EZH2, KDM4A/JMJD2A, and CKD1.

In one embodiment, the transcription activator is GAL4, VP16, VP64, a p65 subdomain (NFkB), a histone lysine methyltransferase (KMT), a histone lysine demethylate (KDM), a histone lysine acetyltransferase (KAT), a DNA demethylase, or a protein docking element. In one embodiment, the KMT is hSET1A, hSET1B, MLL1, MLL2, MLL3, MLL4, MLL5, ASH1, Trx, Trr, Ash1, SYMD2, NSD1, or DOT1. In one embodiment, the KDM is LSD1/BHC110, JHDM2a/b, UTX, or JMJD3. In one embodiment, the KAT is hGCN4, PCAF, dGCN5/PCAF, Gcn5, CBP, p300, dCBP/NEJ, TAF1, TIP60/PLIP, MOZ/MYST3, MORF/MYST4, Mst2, Sas3, CG1894, HBO1/MYST2, CHM, Mst2, HMOF/MYST1, dMOF, Sas2, Mst2, SRC1, ACTR, P160, or CLOCK. In one embodiment, the DNA demhetylase is AID, TET1, DME, DML1, DML2, ROS1. In one embodiment, the protein docking element is FKBP/FRB (*S. pombe*) or Pil1/Abyl (*E. coli*).

In one embodiment, the transcription repressor is KRAB, Mad mSIN3 interaction domain, the ERF repressor domain, a histone lysine methyltransferase (KMT), a histone lysine demethylase (KDM), a histone lysine deacetylase, a DNA methylase, a boundary element, or a periphery recruitment element. In one embodiment, the KMT is SUV39H1, SUV39H2, G9A, Pr-SET7/8, SUV4-10H1, PR-set7, Suv4-20, Set9, EZH2, RIZ1, LSD1/BHC110, SpLsd1/Swm1/Saf110, Su(var)3-3, JMJD2A/JHDM3A, JMJD2B, JMJD2C/GASC1, JMJD2D, Rph1, JARID1A/RBP2, JARID1B/PLU-1, JARID1C/SMCX, JARID1D/SMCY, Lid, Jhn2, or Jmj2. In one embodiment, the histone lysine deacetylase is HDAC1, HDAC2, HDAC3, HDAC8, Rpd3, Hos1, Cir6, HDAC4, HDAC5, HDAC7, HDAC9, Hda1, Cir3, SIRT1, SIRT2, Sir2, Hst1, Hst2, Hst3, HSt4, or HDAC11. In one embodiment, the DNA methylase is Dam, Dcm, M. SssI, DNMT1, DNMT3a/DNMT3b, METI, DRM3, ZMET2, CMT1, or CMT2. In one embodiment, the boundary element is CTCF. In one embodiment, the periphery recruitment element is LaminA or Lamin B.

In another aspect, described herein is a vector comprising a Cas9 system, wherein said Cas9 system is a composition comprising a nucleic acid. In one embodiment, the vector is a viral vector. In one embodiment, the vector is an AAV vector. In one embodiment, the vector is IDLV.

In another aspect, described herein is a reaction mixture comprising a Cas9 system, a cell or population of cells described herein, and a solution. In one embodiment, the solution is a cell growth medium.

In another aspect, described herein is a method of altering the structure of a cell comprising contacting the cell with a composition, kit, or Cas9 system described herein, or a vector described herein, under conditions that allow for alteration of the structure of the cell, thereby altering the structure of the cell. In one embodiment, the structure of the cell is altered by altering the sequence of a target nucleic acid in the cell.

In another aspect, described herein is a method of treating a subject by altering the structure of a cell in the subject, comprising contacting the cell with a composition, kit, or Cas9 system described herein, or a vector described herein, under conditions that allow for alteration of the structure of the cell, thereby treating the subject. In one embodiment, the subject has a disorder that is caused by a mutation in the target nucleic acid.

In another aspect, described herein is a method of promoting DNA repair of a break in a target nucleic acid via an HDR pathway, the method comprising contacting a cell comprising the target nucleic acid with a composition, Cas9 system, or vector described herein under conditions that allow for repair of the break in the target nucleic acid in the cell via an HDR pathway.

In another aspect, described herein is a method of promoting DNA repair of a double strand break in a target nucleic acid in a cell by an HDR pathway, the method comprising contacting the cell with a gRNA molecule, a Cas9 molecule, and a second gRNA molecule, wherein the gRNA molecule and the second gRNA molecule are oriented on the target nucleic acid such that protospacer adjacent motifs (PAMs) are facing out, wherein the Cas9 nickase molecule cuts the target nucleic acid, resulting in a first 5' overhang and a second 5' overhang, thereby promoting DNA repair of the double strand break in the target nucleic acid in the cell via an HDR pathway. In one embodiment, the method further comprises contacting the cell with a template nucleic acid, wherein the template nucleic acid is a single stranded oligonucleotide. In one embodiment, the method further comprises contacting the cell with a template nucleic acid, wherein the template nucleic acid is an endogenous nucleic acid.

In one embodiment, the altered sequence of the target nucleic acid is a deletion in the target nucleic acid. In one embodiment, a mutant or disease phenotype is converted to a non-mutant or non-disease phenotype. In one embodiment, altering the sequence of the target nucleic acid comprises creating a break in the target nucleic acid. In one embodiment, the break is a single strand break. In one embodiment, the break is a double strand break. In one embodiment, the double strand break is blunt-ended or comprises one or two overhangs.

In one embodiment, altering the sequence of the target nucleic acid comprises resection. In one embodiment, resection occurs at a double strand break. In another embodiment, resection occurs at a single strand break.

In one embodiment, the sequence of the target nucleic acid is altered via HR-mediated repair, SSA-mediated repair, or alt-HR-mediated repair. In one embodiment, the level of HR-mediated repair, SSA-mediated repair, or alt-HR-mediated repair is increased as compared to the level of HR-mediated repair, SSA-mediated repair, or alt-HR-mediated repair that would occur in the absence of the HDR-enhancer or in the absence of the eaCas9 molecule.

In one embodiment, the method comprises contacting the cell with a nucleic acid encoding DNA encoding the gRNA, and allowing the cell to produce the gRNA. In one embodiment, the method comprises contacting the cell with a nucleic acid encoding the Cas9 molecule, and allowing the cell to produce the Cas9 molecule. In one embodiment, the method comprises contacting the cell with a nucleic acid that encodes both the gRNA and the Cas9 molecule, and allowing the cell to produce the gRNA and the Cas9 molecule. In one embodiment, the method comprises contacting the cell with a nucleic acid that encodes the gRNA, the Cas9 molecule, and the template nucleic acid; and allowing the cell to produce the gRNA and the Cas9 molecule. In one embodiment, the method comprises contacting the cell with a nucleic acid that encodes the HDR-enhancer, and allowing the cell to produce the HDR-enhancer.

In one embodiment, the HDR-enhancer molecule is a chromatin modifying agent. In one embodiment, the chromatin modifying agent is a chromatin modifying agent other than CKD1. In one embodiment, the chromatin at the target nucleic acid is altered.

In one embodiment, the method further comprises assaying the chromatin state of the cell. In one embodiment, the chromatin state of the target nucleic acid is assayed. In another embodiment, assaying cell cycle status of the cell comprises determining whether the cell is in G2 phase.

In one embodiment, the HDR-enhancer molecule is a cell cycle arrest agent. In one embodiment, the cell cycle arrest agent is not a Cdk1 inhibitor. In one embodiment, the cell arrests in G2. In one embodiment, the cell reversibly arrests in G2.

In one embodiment, the method only substantially downregulates one DNA repair pathway, or wherein the cell is contacted with only one HDR-enhancer.

In one embodiment, the method further comprising contacting the cell with a second gRNA, wherein the gRNA is configured to guide the Cas9 molecule to produce a first break, and the second gRNA is configured to guide a second Cas9 molecule to produce a second break. In one embodiment, the first break is a single strand break and the second break is a single strand break, the first break is a single strand break and the second break is a double strand break, the first break is a double strand break and the second break is a single strand break, or the first break is a double strand break and the second break is a double strand break.

In one embodiment, the method further comprises contacting the cell with a third gRNA, wherein the third gRNA is configured to guide a third Cas9 molecule to produce a third break. In one embodiment, the method further comprises contacting the cell with a fourth gRNA, wherein the fourth gRNA is configured to guide a fourth Cas9 molecule to produce a fourth break.

In one embodiment, the method further comprises a step of removing the cell from the subject's body before contacting the cell with the gRNA, the Cas9 molecule, the template nucleic acid, or the HDR-enhancer. In one embodiment, the method further comprises a step of returning the cell to the subject's body after contacting the cell with the gRNA, the Cas9 molecule, the template nucleic acid, or the HDR-enhancer. In one embodiment, the method further comprises a step of placing the cell in a subject's body after contacting the cell with the gRNA, the Cas9 molecule, the template nucleic acid, or the HDR-enhancer.

In one embodiment, the cell is contacted with the HDR-enhancer after being contacted with one or more of the gRNA, the Cas9 molecule, and/or template nucleic acid.

In one embodiment, the cell is contacted with the HDR-enhancer before being contacted with one or more of the gRNA, the Cas9 molecule, and/or the template nucleic acid.

In one embodiment, the cell is contacted with two or more of the gRNA, the Cas9 molecule, the template nucleic acid, and the HDR-enhancer at substantially the same time. In one embodiment, the cell is contacted with the gRNA and the Cas9 molecule at substantially the same time.

In one embodiment, a target position in the target nucleic acid is altered to comprise the sequence of at least a portion of a template nucleic acid. In one embodiment, the target nucleic acid bears a mutation relative to a corresponding wild-type sequence, and wherein a template nucleic acid comprises the corresponding wild-type sequence. In one embodiment, the target nucleic acid is pathogenic DNA, and wherein a template nucleic acid contains a mutation relative to the pathogenic DNA.

In one embodiment, a subject has a disorder that is caused by a mutation in the target nucleic acid. In one embodiment, the disorder is cancer, a genetic disease, an infectious disease, a disorder caused by aberrant mitochondrial DNA (mtDNA), a metabolic disease, a disorder caused by aberrant cell cycle, a disorder caused by aberrant angiogenesis, a disorder caused by aberrant DNA damage repair, or a pain disorder.

In one embodiment, the method further comprises a step of removing the cell from the subject's body before contacting the cell with the composition or the vector, and a step of returning the cell to the subject's body after contacting the cell with the composition or the vector. In one embodiment, the cell is present in the body of a subject. In one embodiment, the cell is not present in the body of a subject. In one embodiment, the cell is present in a tissue culture vessel.

In one embodiment, the cell is in G1 phase at the time the cell is contacted with the composition or the vector. In one embodiment, the cell is in G1 phase at the time the Cas9 molecule cleaves the target position. In one embodiment, the cell is in G1 phase at the time the Cas9 molecule-mediated break is repaired by HDR.

In one embodiment, the cell is in S phase at the time the cell is contacted with the composition or the vector. In one embodiment, the cell is in S phase at the time a Cas9 molecule cleaves a target position. In one embodiment, the cell is in S phase at the time a Cas9 molecule-mediated break is repaired by HDR.

In one embodiment, the cell is in G2 phase at the time the cell is contacted with the composition or the vector. In one embodiment, the cell is in G2 phase at the time a Cas9 molecule cleaves a target position. In one embodiment, the cell is in G2 phase at the time a Cas9 molecule-mediated break is repaired by HDR.

In one aspect, described herein is a method of producing the composition, cell, population of cells, kit, or Cas9 system described herein, the method comprising: providing one or more of the gRNA molecule and the Cas9 molecule; providing the HDR-enhancer molecule; and admixing one or more of the gRNA molecule and the Cas9 molecule with the HDR-enhancer molecule. In one embodiment, the method further comprises providing a template nucleic acid and admixing one or more of the gRNA molecule, the Cas9 molecule, the HDR-enhancer molecule with the template nucleic acid.

An additional way of promoting genome editing involves the mismatch repair (MMR) pathway. Certain forms of genome editing, such as an alt-HR pathway, can produce a mismatch in the genome. In some cases the MMR pathway "corrects" the mismatch back to the original sequence, which is an undesirable outcome. To safeguard the edit in the genome, one can down-regulate the MMR pathway in the edited cell.

In one aspect, described herein is a Cas9 system comprising a down-regulator of MMR and one or more of a gRNA molecule and a Cas9 molecule. In one embodiment, the down-regulator of MMR is an inhibitor of a factor listed in Table VI.15. In one embodiment, the down-regulator of MMR is an siRNA, an antibody, a small molecule, or an HDR-enhancing gRNA. In one embodiment, the antibody is an intrabody. In one embodiment, the siRNA or the antibody is directed against a factor listed in Table VI.15. In one embodiment, the down-regulator of MMR is an agent of Table VI.16. In one embodiment, the Cas9 system further comprises a template nucleic acid. In one embodiment, the down-regulator of MMR increases the likelihood that a mismatched base pair in the target nucleic acid will be resolved to have a sequence corresponding to the sequence of a template nucleic acid rather than the sequence of the target nucleic acid before the mismatch was created.

In one embodiment, the Cas9 system comprises a nucleic acid encoding the down-regulator of MMR and one or more nucleic acids encoding a gRNA or a Cas9 polypeptide. In one embodiment, the nucleic acids are present in one or more vectors. In one embodiment, the one or more vectors is one or more an AAV vectors.

In another aspect, described herein is a reaction mixture comprising a cell or population of cells described herein, and a solution. In one embodiment, the solution is a growth medium.

In another aspect, the described herein is a method of altering the structure of a cell comprising contacting the cell with a Cas9 system described herein, resulting in alteration of the structure of the cell. In one embodiment, the altering the structure of the cell comprises altering the sequence of a target nucleic acid of the cell.

In another aspect, the described herein is a method of treating a subject by altering the structure of a cell in said subject, comprising contacting the cell with a composition, kit, or Cas9 system described herein under conditions that allow for alteration of the structure of the cell, thereby treating the subject.

In other circumstances, it is desirable to provide an environment favoring nucleotide insertions and/or deletions at the break site via an error-prone repair (EPR) pathway such as alt-NHEJ. To cause a cell to favor an EPR pathway, one can omit a template nucleic acid and contact the cell with an agent that enhances an EPR pathway. An EPR enhancer can be, e.g., an agent that inhibits another DNA damage repair pathway, with the result that the cell becomes more likely to use an alt-NHEJ pathway rather than the inhibited pathway. Other EPR-enhancers directly stimulate an EPR pathway.

In another aspect, the invention provides a Cas9 system comprising an error-prone repair (EPR)-enhancer and one or more of a gRNA molecule and a Cas9 molecule. In one embodiment, the Cas9 system does not comprise a template nucleic acid. In one embodiment, the Cas9 system further comprises a template nucleic acid. In one embodiment, the Cas9 system comprises a nucleic acid encoding the EPR-enhancer and one or more nucleic acids encoding the gRNA or the Cas9 polypeptide. In one embodiment, the nucleic acids are present in one or more vectors. In one embodiment, the vector is an AAV vector.

In one embodiment, the EPR-enhancer is a down-regulator of HDR, an up-regulator of alt-NHEJ, an inhibitor of BRCA1, an up-regulator of SSA, a down-regulator of C-NHEJ, or an agent that promotes resection. In one embodiment, the down-regulator of HDR is an inhibitor of a protein of Table VI.1(C) or VI.2 or an agent of Table VI.3. In one embodiment, the up-regulator of alt-NHEJ is a protein of Table VI.9 or VI.1(J), or an amino acid comprising at least 60, 70, 80, 90, 95, 98, 99 or 100% homology with, or which differs by no more than 50, 40, 30, 20, 15, 10, 5, 4, 3, 2, or 1, amino acid residues from a protein of Table VI.9 or VI.1(J). In one embodiment, the inhibitor of BRCA1 is an siRNA or antibody directed against BRCA1. In one embodiment, the up-regulator of SSA is an inhibitor of BRCA2 or RAD51. In one embodiment, the inhibitor is an siRNA, an antibody, or an HDR-enhancing gRNA. In one embodiment, the down-regulator of C-NHEJ is an inhibitor of a protein of Table VI.1(B) or VI1.7, or an agent of Table VI.8. In one embodiment, the agent that promotes resection is a recombinant pro-resection protein or an inhibitor of an anti-resection protein. In one embodiment, the pro-resection protein is a nuclease. In one embodiment, the anti-resection protein is 53BP1, Rif1, or PTIP. In one embodiment, the agent that promotes resection is an agent of Table VI.8. In one embodiment, the inhibitor of an anti-resection protein is a dominant negative 53BP1 protein.

In one aspect, provided herein is a method of altering the structure of a cell comprising contacting the cell with a composition, kit, or Cas9 system described herein, resulting in alteration of the structure of the cell.

In another aspect, described herein is a method of treating a subject by altering the structure of a cell in said subject, comprising contacting the cell with a composition, kit, or Cas9 system described herein, resulting in alteration of the sequence of the target nucleic acid. In one embodiment, no template nucleic acid is provided. In one embodiment, the structure of the cell is altered by altering the structure of a target nucleic acid, and wherein the structure of the nucleic acid is altered via alt-NHEJ-mediated repair or SSA-mediated repair.

In some embodiments, the HDR-enhancer molecule is an HDR-enhancer of Section 1 of this Summary, entitled "Exemplary HDR-enhancers." In embodiments, the gRNA is a gRNA of Section 2 of this Summary, entitled "Characteristics of the gRNA." In embodiments, the Cas9 molecule is a Cas9 molecule of Section 3 of this Summary, entitled "Characteristics of the Cas9 molecule." In embodiments, the template nucleic acid is a template nucleic acid of Section 4 of this Summary, entitled "Characteristics of the template." In embodiments, the cell is a cell of Section 5 of this Summary, entitled "Characteristics of the cell." In embodiments, one or more of Properties (i)-(x) are present and are as described in Section 6 of this Summary, entitled "Properties (i)-(x) and characterization thereof." In embodiments, a composition comprises a characteristic set out in Section 9 of this Summary, entitled "Characteristics of nucleic acid compositions." In embodiments, the composition comprises a characteristic set out in Section 10 of this Summary, entitled "Additional characteristics of Cas9 systems."

1. Exemplary HDR-Enhancers

In some embodiments, the HDR-enhancer molecule is a down-regulator of HR, a down-regulator of canonical NHEJ, a down-regulator of alt-NHEJ, a down-regulator of an antirecombinant factor, a down-regulator of SSA, a down-regulator of SSBR, a down-regulator of MMR, a chromatin modification agent, a cell cycle arrest compound, an agent capable of promoting resection at a double strand break, a down-regulator of SD-MMEJ, or a down-regulator of blunt EJ. In one embodiment, the HDR-enhancer molecule is a down-regulator of anti-HR (e.g., an inhibitor of a protein which inhibits HR or promotes repression of HR). In some embodiments, other HDR pathways, such as alt-HR and/or SSA, are promoted and/or the HDR-enhancer molecule is capable of promoting other HDR pathways, such as alt-HR and/or SSA, e.g., as compared to what would be seen in the absence of the down-regulator of anti-HR. In some embodiments, the HDR-enhancer molecule is an inhibitor of a component of Table VI.4 or Table VI.1(D). In some embodiments, the HDR-enhancer molecule is an antibody, e.g., an intrabody, or an siRNA, directed, e.g., against a component from Table VI.4 or Table VI.1(D). In other embodiments, the HDR-enhancer molecule is an HDR-enhancing gRNA directed against one of the repressors or activators described in Example 13. In some embodiments, the HDR-enhancer molecule is an agent of Table VI.5. In some embodiments, the HDR-enhancer inhibits Fbh1, PARI, Rap80, miR-155, miR-545, miR-107, miR-1255, miR-148, or miR-193. In some embodiments, the HDR-enhancer that inhibits Fbh1 is an siRNA. In some embodiments, the HDR-enhancer that inhibits PARI is an siRNA. In some embodiments, the HDR-enhancer that inhibits RAP80 is an siRNA. In some embodiments, the HDR-enhancer that inhibits miR-155, miR-545, miR-107, miR-1255, miR-148, or miR-193 is an anti-miR.

In some embodiments, the HDR-enhancer molecule is a down-regulator of SSA (e.g., an inhibitor of a protein, which protein promotes SSA). In embodiments, other HDR pathways, such as alt-HR and/or alt-HR are promoted, e.g., as compared to what would be seen in the absence of the down-regulator of SSA. In embodiments the HDR-enhancer molecule is an inhibitor of a component of Table VI.1(E) or VI.11. In embodiments, the HDR-enhancer molecule is an antibody, e.g., an intrabody, or an siRNA, directed, e.g., against a component from Table VI.1(E) or VI.11. In other embodiments, the HDR-enhancer molecule is an HDR-enhancing gRNA directed against one of the repressors or activators described in Example 13. In embodiments the HDR-enhancer molecule is an agent of Table VI.12. In embodiments the HDR-enhancer inhibits Rad52 or ERCC1. In embodiments the HDR-enhancer that inhibits Rad52 or ERCC1 is an siRNA.

In embodiments, the HDR-enhancer molecule is a chromatin modification agent (e.g., an agent that inhibits a chromatin modification protein that promotes a DNA repair pathway). In some embodiments, the chromatin modification agent is not an HDAC, e.g., is not HDAC1 or HDAC2. In embodiments HDR is promoted and/or the HDR-enhancer molecule is capable of promoting HDR, e.g., as compared to what would be seen in the absence of the chromatin modification agent. In embodiments the HDR-enhancer molecule is administered in an amount sufficient to alter chromatin at the target nucleic acid. In embodiments the chromatin at the target nucleic acid is altered. In embodiments, the chromatin modification agent is not an HDAC, e.g., is not HDAC1 or HDAC2. In embodiments, the HDR-enhancer molecule is a modulator, e.g., inhibitor, of a component of Table VI.1(I). In embodiments, the HDR-enhancer molecule is an antibody, e.g., an intrabody, or an siRNA, directed, e.g., against a component from Table VI.1(I). In another embodiment, the HDR-enhancer molecule is an HDR-enhancing gRNA as described herein and in Example 13. In embodiments, the HDR-enhancer molecule is an agent of Table VII. In embodiments, the HDR-enhancer inhibits EZH2 or an HDAC. In embodiments, the HDR-enhancer that inhibits EZH2 is EPZ-6438. In embodiments, the HDR-enhancer that inhibits the HDAC is TCA.

In embodiments, the HDR-enhancer molecule is a down-regulator of SSBR (e.g., an inhibitor of a protein, which protein promotes SSBR). In embodiments, HDR is promoted and/or the HDR-enhancer molecule is capable of promoting HDR, e.g., as compared to what would be seen in the absence of the down-regulator of SSBR. In embodiments, the HDR-enhancer molecule is an inhibitor of a component of Table VI.13 or VI.1(F). In embodiments, the HDR-enhancer molecule is an agent of Table VI.14. In embodiments, the HDR-enhancer molecule is an antibody, e.g., an intrabody or an siRNA, directed, e.g., against a component from Table VI.13 or VI.1(F). In another embodiment, the HDR-enhancer molecule is an HDR-enhancing gRNA as described herein or in Example 13. In embodiments, the HDR-enhancer inhibits a PARP or XRCC1. In embodiments, the HDR-enhancer that inhibits a PARP is selected from: AZD2281, KU-0059436, and BMN673. In embodiments, the HDR-enhancer that inhibits XRCC1 is an siRNA.

In embodiments, the HDR-enhancer molecule is an agent capable of promoting resection and/or promotes resection at a single or double strand break. In embodiments, HDR is promoted and/or the HDR-enhancer capable of promoting resection is capable of promoting HDR, e.g., as compared to what would be seen in the absence of the HDR-enhancer that promotes resection. In embodiments, the HDR-enhancer that promotes resection at a single or double strand break is an endonuclease or exonuclease. In embodiments, the HDR-enhancer that promotes resection is an inhibitor of an anti-resection protein, e.g., an anti-resection protein of Table VI.1(A). In embodiments, the HDR-enhancer molecule is an antibody, e.g., an intrabody, or an siRNA, directed, e.g., against a component from Table VI.1(A). In one embodiment, the HDR-enhancer molecule is an HDR-enhancing gRNA as described herein or in Example 13. In embodiments, the HDR-enhancer that is an inhibitor of an anti-resection protein is an inhibitor of 53BP1, Rif-1, or PTIP. In one embodiment, the inhibitor of an anti-resection protein is a dominant negative 53BP1 protein.

In embodiments, the HDR-enhancer molecule is a down-regulator of SDMMEJ. In embodiments, the HDR-enhancer molecule is an inhibitor of Pol Theta. In embodiments, the HDR-enhancer molecule is a down-regulator of EJ.

In embodiments, the HDR-enhancer molecule is an agent that promotes cell cycle arrest in G2. In embodiments, the HDR-enhancer molecule is administered in an amount sufficient to cause the cell to arrest in G2. In embodiments, the cell arrests in G2, e.g., reversibly arrests in G2. In embodiments, the HDR-enhancer molecule is a CDK1 inhibitor. In embodiments, the HDR-enhancer molecule is not a CDK1-inhibitor. In embodiments, the HDR-enhancer molecule is an agent of Table VIII.

In embodiments, the HDR-enhancer molecule is a down-regulator of C-NHEJ. In embodiments, HDR is promoted and/or the down-regulator of C-NHEJ is capable of promoting HDR, e.g., as compared to what would be seen in the absence of the down-regulator of C-NHEJ. In embodiments, the HDR-enhancer molecule is an inhibitor of a component of Table VI.7 or VI.1(B). In embodiments, the HDR-enhancer molecule is an antibody, e.g., an intrabody, or an siRNA, directed, e.g., against a component from Table VI.7 or VI.1(B). In embodiments, the HDR-enhancer molecule is an HDR-enhancing gRNA as described herein or in Example 13. In embodiments, the HDR-enhancer molecule is an agent of Table VI.8. In embodiments, the HDR-enhancer molecule is an inhibitor of DNA Pk or 53BP1. In embodiments, the HDR-enhancer that inhibits DNA Pk is selected from: NU7441, CC115, and NK314. In embodiments, the HDR-enhancer that inhibits 53BP1 is an siRNA targeting 53BP1. In one embodiment, the inhibitor of an anti-resection protein is a dominant negative 53BP1 protein.

In embodiments, the HDR-enhancer molecule is a down-regulator of alt-NHEJ, e.g., SD-MMEJ. In embodiments, HDR is promoted and/or the down-regulator of alt-NHEJ is capable of promoting HDR, e.g., as compared to what would be seen in the absence of the down-regulator of alt-NHEJ. In embodiments, the HDR-enhancer molecule is an inhibitor of a component of Table VI.9 or Table VI.1(J). In embodiments, the HDR-enhancer molecule is an antibody, e.g., an intrabody or an siRNA, directed, e.g., against a component from Table VI.9 or Table VI.1(J). In embodiments, the HDR-enhancer molecule is an agent of Table VI.10. In embodiments, the HDR-enhancer molecule is an HDR-enhancing gRNA as described herein.

In embodiments, the HDR-enhancer molecule is an up-regulator of HDR. In embodiments, the up-regulator of HDR is a protein selected from: MRE11, RAD50, NBS1, BRCA2, and BRCA1, or an amino acid comprising at least 60, 70, 80, 90, 95, 98, 99 or 100% homology with, or which differs by no more than 50, 40, 30, 20, 15, 10, 5, 4, 3, 2, or 1, amino acid residues from a naturally occurring MRE11, RAD50, NBS1, BRCA2, or BRCA1. In embodiments, the up-regulator of HDR is a protein of Table VI.2 or a protein of Table VI.1(C), or an amino acid comprising at least 60, 70, 80, 90, 95, 98, 99 or 100% homology with, or which differs by no more than 50, 40, 30, 20, 15, 10, 5, 4, 3, 2, or 1, amino acid residues from, a sequence of Table VI.2 or Table VI.1(C). In another embodiment, the up-regulator of HDR is a dominant negative CtIP. A dominant negative CtIP promotes resection in G1 phase.

In embodiments, the HDR-enhancer molecule is a down-regulator of one HDR pathway (e.g., an inhibitor of a protein, which protein promotes HDR). In embodiments, alt-HR or SSA is promoted and/or the down-regulator of HDR is capable of promoting alt-HR or SSA, e.g., as compared to what would be seen in the absence of the down-regulator of HDR. In embodiments, the HDR-enhancer molecule is an inhibitor of a component of Table VI.2 or VI.1(C). In embodiments, the HDR-enhancer molecule is an antibody, e.g., an intrabody, or an siRNA, directed, e.g., against a component from Table VI.2 or VI.1(C). In embodiments, the HDR-enhancer molecule is an agent of Table VI.3. In embodiments, the HDR-enhancer inhibits BRCA2, BRCA1, or RAD51. In embodiments, the HDR-enhancer molecule is an antibody, e.g., an intrabody, or an siRNA, directed, e.g., against a BRCA2, BRCA1, or RAD51. In some embodiments, the HDR-enhancer molecule is an HDR-enhancing gRNA as described herein and in Example 13. In embodiments, the HDR-enhancer molecule is an siRNA directed against BRCA2, BRCA1, or RAD51. In embodiments, the HDR-enhancer molecule is selected from: B02, A03, AI-10, RI-1, RI-2, and IBR2.

In embodiments, HDR-enhancer comprises an siRNA. In embodiments, the HDR-enhancer comprises an siRNA directed against an mRNA that encodes a target. In embodiments, the HDR-enhancer comprises a polypeptide, e.g., an antibody, e.g., an intrabody, optionally comprising a nuclear localization sequence.

In embodiments, the Cas9 system comprises an additional one or more HDR-enhancers, e.g., exactly two or exactly three HDR-enhancers. In embodiments, the HDR-enhancer of and the additional HDR-enhancer are capable of (i) up-regulating the same pathway, or (ii) down-regulating the same pathway.

2. Characteristics of the gRNA

In embodiments, the gRNA comprises a targeting domain, first and second complementary domains, and a proximal domain.

In embodiments, the gRNA is chimeric. In embodiments, the gRNA is modular.

In embodiments, the at least one domain of a preselected length is a targeting domain which is 12-30 nucleotides in length. In embodiments, the targeting domain is at least 20, 21, 22, 23, 24, 25, 26, 27, 28, 29, or 30 nucleotides in length. In embodiments, the targeting domain is at most 20, 19, 18, 17, or 16 nucleotides in length. In embodiments, the first complementarity domain is at least 12, 13, 14, 15, 16, 17, 18, 19, 20, 21, 22, 23, 24, or 25 nucleotides in length. In embodiments, the first complementarity domain is at most 12, 11, 10, 9, 8, or 7 nucleotides in length. In embodiments, the linking domain is at least 4, 5, 6, 7, 8, 9, 10, 15, 20, or 25 nucleotides in length. In embodiments, the linking domain is at most 4, 3, or 2 nucleotides in length. In embodiments, the second complementarity domain is at least 14, 15, 16, 17, 18, 19, 20, 21, 22, 23, 24, or 25 nucleotides in length. In embodiments, the second complementarity domain is at most 12, 11, 10, 9, 8, 7, 6, or 5 nucleotides in length. In embodiments, the at least one domain of a preselected length is a domain encompassing the proximal domain and the tail domain, which taken together are at least 15, 18, 20, 25, 30, 31, 35, 40, 45, 49, 50, or 53 nucleotides in length. In an embodiment, the 5' extension domain is, 2-10, 2-9, 2-8, 2-7, 2-6, 2-5, 2-4 nucleotides in length. In an embodiment, the 5' extension domain is 2, 3, 4, 5, 6, 7, 8, 9, or 10 or more nucleotides in length.

In embodiments, the Cas9 system further comprises a second gRNA. In embodiments, the gRNA of (a) is configured to guide the Cas9 molecule of (b) to produce a first break, and a second gRNA is configured to guide a second Cas9 molecule to produce a second break. In one embodiment, the gRNA of (a) and the second gRNA are configured to position the first break and the second break: within 55 nucleotides of one another; at least 25 nucleotides apart; or within 25-65 nucleotides of one another.

3. Characteristics of the Cas9 Molecule

In embodiments, the Cas9 molecule is an eaCas9 molecule. In embodiments, the eaCas9 forms a double strand break in the target nucleic acid.

In embodiments, the Cas9 molecule is a protein selected from Table III.1, e.g., a Cas9 molecule other than a *S. pyogenes* Cas9 molecule. In some embodiments, the Cas9 molecule is a *S. pyogenes* Cas9 molecule. In other embodiments, the Cas9 molecule is a *S. aureus* Cas9 molecule.

In embodiments, the eaCas9 molecule comprises N-terminal RuvC-like domain cleavage activity and HNH-like domain cleavage activity. In embodiments, the eaCas9 molecule forms a single strand break in a target nucleic acid. In embodiments, the eaCas9 molecule comprises HNH-like domain cleavage activity but has no, or no significant, N-terminal RuvC-like domain cleavage activity. In embodiments, the eaCas9 molecule is an HNH-like domain nickase. In embodiments, the eaCas9 molecule comprises a mutation at D10. In embodiments, the eaCas9 molecule comprises N-terminal RuvC-like domain cleavage activity but has no, or no significant, HNH-like domain cleavage activity. In embodiments, the eaCas9 molecule is an N-terminal RuvC-like domain nickase. In embodiments, the eaCas9 molecule comprises a mutation at H840.

In embodiments, the Cas9 molecule comprises a $REC_2$ deletion, $REC1_{CT}$ deletion, or a $REC1_{SUB}$ deletion, or any combination thereof. In embodiments, the Cas9 molecule comprises an altered PI domain.

In embodiments, the Cas9 molecule is less than about 1300 amino acids in length. In embodiments, the Cas9 molecule is: less than about 1200, 1100, 1000, 900, or 800 amino acids in length; or between about 800-1300, 900-1200, 900-1100, or 900-1000 amino acids in length.

In embodiments, the Cas9 molecule is a protein selected from Table III.1 In some embodiments, the Cas9 molecule is not a *S. pyogenes* Cas9, e.g., does not comprise SEQ ID NO: 2. In one embodiment, the Cas9 molecule is an *S. aureus* Cas9 molecule. In one embodiment, the Cas9 molecule is an *S. pyogenes* Cas9 molecule.

In embodiments, the Cas9 system further comprises a second Cas9 molecule. In embodiments, the Cas9 molecule of (b) is a nickase and the second Cas9 molecule is a nickase; the Cas9 molecule of (b) can catalyze a double strand break and the second Cas9 molecule is a nickase; the Cas9 molecule of (b) is a nickase and the second Cas9 molecule can catalyze a double strand break; or the Cas9 molecule of (b) can catalyze a double strand break and the second Cas9 molecule can catalyze a double strand break.

In some embodiments, the Cas9 recognizes a PAM site other than NGG, e.g., other than AGG. In some embodiments, the Cas9 recognizes an inverted PAM site, e.g., a Pam site that faces outward.

In embodiments, the Cas9 molecule targeted by the gRNA of (a) has the same structure, e.g., amino acid sequence, as the Cas9 molecule targeted by the second gRNA. In other embodiments, the Cas9 molecule targeted by the gRNA of (a) has a different structure, e.g., amino acid sequence, as the Cas9 molecule targeted by the second gRNA.

4. Characteristics of the Template

In embodiments, the template nucleic acid comprises, or comprises a part of, a circular nucleic acid. In embodiments, the template nucleic acid is a circular nucleic acid, e.g., a plasmid. In embodiments, the template nucleic acid is a linear nucleic acid. In some embodiments, the template nucleic acid is DNA. In some embodiments, the template nucleic acid is RNA. In embodiments, the template nucleic acid comprises a double stranded sequence or a single strand sequence, e.g., a single stranded oligonucleotide. In one embodiment, the template is a single stranded/double-stranded DNA hybrid. In another embodiment, the template is present on a circular plasmid. In one embodiment, the donor template is in an AAV or an IDLV. In yet another embodiment, the template nucleic acid is an endogenous nucleic acid. In embodiments, the template nucleic acid comprises about 150-200 nucleotides of homology with a target nucleic acid. In embodiments, the template nucleic acid is linear and comprises about 150-200 nucleotides of homology with a target nucleic acid. In embodiments, the 150-200 nucleotides of homology correspond to one side of a break in a target nucleic acid. In embodiments, the 150-200 nucleotides of homology correspond to two sides of a break in a target nucleic acid. In embodiments, the template nucleic acid comprises about 500-2000 nucleotides of homology with a target nucleic acid.

In embodiments, the template nucleic acid is circular and comprises about 500-2000 nucleotides of homology with a target nucleic acid. In embodiments, the 500-2000 nucleotides of homology correspond to one side of a break in a target nucleic acid. In embodiments, the 500-2000 nucleotides of homology correspond to two sides of a break in a target nucleic acid. In embodiments, the template nucleic acid has homology to the target nucleic acid on one side of the break. In embodiments, the template nucleic acid has homology to the target nucleic acid on two sides of the break.

In embodiments, the template nucleic acid comprises a human sequence, e.g., a wild-type human sequence. In embodiments, the template nucleic acid comprises a wild-type human sequence corresponding to a mutation at a target nucleic acid. In embodiments, the template nucleic acid lacks repeated elements such as an Alu sequence or a LINE sequence.

In embodiments, the template nucleic acid comprises a modified nucleic acid.

In embodiments, one or both of the 3' and 5' homology arms, each independently has a length of: at least 50, 100, 250, 500, 750, 1000, 2000, 3000, 4000, or 5000 nucleotides; no more than 50, 100, 250, 500, 750, 1000, 2000, 3000, 4000, or 5000 nucleotides; or between 50-100, 100-250, 250-500, 500-750, 750-1000, 1000-2000, 2000-3000, 3000-4000, or 4000-5000 nucleotides.

In embodiments, a homology arm (e.g., the 5' homology arm or the 3' homology arm, or both) has a 5' end and a 3' end and: the 5' end is at least 50, 100, 250, 500, 750, 1000, 2000, 3000, 4000, or 5000 nucleotides from the target position, the 5' end is no more than 50, 100, 250, 500, 750, 1000, 2000, 3000, 4000, or 5000 nucleotides from the target position, the 5' end between 50-100, 100-250, 250-500, 500-750, 750-1000, 1000-2000, 2000-3000, 3000-4000, or 4000-5000 nucleotides from the target position, the 3' end is at least 50, 100, 250, 500, 750, 1000, 2000, 3000, 4000, or 5000 nucleotides from the target position, the 3' end is no more than 50, 100, 250, 500, 750, 1000, 2000, 3000, 4000, or 5000 nucleotides from the target position, or the 3' end between 50-100, 100-250, 250-500, 500-750, 750-1000, 1000-2000, 2000-3000, 3000-4000, or 4000-5000 nucleotides from the target position. In embodiments, the replacement sequence has a length of: at least 1, 2, 3, 5, 10, 20, 50, 100, 200, 500, 1000, 2000, 300, 4000, or 5000 nucleotides, no more than 2, 3, 5, 10, 20, 50, 100, 200, 500, 1000, 2000, 300, 4000, or 5000 nucleotides, or between 1-3, 1-5, 1-10 10-20, 20-50, 50-100, 100-200, 200-500, 500-1000, 1000-2000, 2000-3000, 3000-4000, or 4000-5000 nucleotides.

In embodiments, the target nucleic acid bears a mutation relative to a corresponding wild-type sequence, and the template nucleic acid contains the corresponding wild-type sequence. In embodiments, the target nucleic acid is pathogenic DNA, and the template nucleic acid contains a mutation relative to the pathogenic DNA.

In embodiments, the replacement sequence occupies no more than 17%, 16%, 15%, 14%, 13%, 12%, 11%, 10%, 9%, 8%, 7%, 6%, 5%, 4%, 3%, 2%, or 1% of the template nucleic acid. In embodiments, the replacement sequence is at least 17, 18, 19, 20, 25, 30, 40, 50, or 100 nucleotides. In embodiments, the replacement sequence is 1 or 2 nucleotides. In another embodiment, the replacement sequence is 1, 10, 20, 30, 40, 50, 75, 100, 200, 250, 300, 500, 750, or 1000 nucleotides.

5. Characteristics of the Cell

In embodiments, the disclosure provides a cell comprising a Cas9 system described herein.

In embodiments, the cell is a eukaryotic cell. The cell may be, e.g., a vertebrate, mammalian, rodent, goat, pig, bird, chicken, turkey, cow, horse, sheep, fish, primate, plant, or human cell. In embodiments, the cell is a plant cell. The plant cell may be, e.g., monocot or dicot. In embodiments, cell is a mammalian cell, e.g., a human cell. In embodiments, the cell is a somatic cell, germ cell, or prenatal cell. In embodiments, the cell is a zygotic, blastocyst or embryonic cell, a stem cell, a mitotically competent cell, or a meiotically competent cell. In embodiments, the cell is not part of a human embryo. In embodiments, the cell is a somatic cell.

In embodiments, the cell is situated in a subject's body. In embodiments, the cell is not situated in a subject's body. In embodiments, the cell is situated in a tissue culture vessel.

In embodiments, the cell is a T cell, a Hematopoietic Stem Cell, a retinal cell, a cochlear hair cell, a pulmonary epithelial cell, a muscle cell, a neuron, a mesenchymal stem cell, an induced pluripotent stem (iPS) cell, or an embryonic stem cell. In embodiments, the cell is a T cell, a CD8+ T cell, a CD8+ naïve T cell, a central memory T cell, an effector memory T cell, a CD4+ T cell, a stem cell memory T cell, a helper T cell, a regulatory T cell, a cytotoxic T cell, a natural killer T cell, a Hematopoietic Stem Cell, a long term hematopoietic stem cell, a short term hematopoietic stem cell, a multipotent progenitor cell, a lineage restricted progenitor cell, a lymphoid progenitor cell, a myeloid progenitor cell, a common myeloid progenitor cell, an erythroid progenitor cell, a megakaryocyte erythroid progenitor cell, a retinal cell, a photoreceptor cell, a rod cell, a cone cell, a retinal pigmented epithelium cell, a trabecular meshwork cell, a cochlear hair cell, an outer hair cell, an inner hair cell, a pulmonary epithelial cell, a bronchial epithelial cell, an alveolar epithelial cell, a pulmonary epithelial progenitor cell, a striated muscle cell, a cardiac muscle cell, a muscle satellite cell, a neuron, a neuronal stem cell, a mesenchymal stem cell, an induced pluripotent stem (iPS) cell, an embryonic stem cell, a monocyte, a megakaryocyte, a neutrophil, an eosinophil, a basophil, a mast cell, a reticulocyte, a B cell, e.g., a progenitor B cell, a Pre B cell, a Pro B cell, a memory B cell, a plasma B cell, a gastrointestinal epithelial cell, a biliary epithelial cell, a pancreatic ductal epithelial cell, an intestinal stem cell, a hepatocyte, a liver stellate cell, a Kupffer cell, an osteoblast, an osteoclast, an adipocyte, a preadipocyte, a pancreatic islet cell (e.g., a beta cell, an alpha cell, a delta cell), a pancreatic exocrine cell, a Schwann cell, or an oligodendrocyte.

In embodiments, the cell is in G1 phase: at the time the cell is contacted with one or more of (a), (b), (c), and (d); at the time a Cas9 molecule cleaves a target position, or at the time a Cas9 molecule-mediated break is repaired by HDR. In embodiments, the cell is in S phase: at the time the cell is contacted with one or more of (a), (b), (c), and (d); at the time a Cas9 molecule cleaves a target position, or at the time a Cas9 molecule-mediated break is repaired by HDR.

In embodiments, the cell is in G2 phase: at the time the cell is contacted with one or more of (a), (b), (c), and (d); at the time a Cas9 molecule cleaves a target position, or at the time a Cas9 molecule-mediated break is repaired by HDR.

6. Properties (i)-(xi) and Characterization Thereof

In some embodiments, one or more of the following properties is present:

i. the gRNA is configured to position a Cas9 molecule-mediated cleavage event at a preselected position relative to a landmark on the target nucleic acid, wherein the landmark is a site, e.g., a preselected site in the target nucleic acid, wherein the target position or the landmark or both are present on an endogenous chromosomal segment, e.g., are not part of a heterologous reporter gene;

ii. the Cas9 system further comprises a second gRNA suitable for targeting a Cas9 molecule to the target nucleic acid;

iii. the gRNA comprises at least one domain of a preselected length, e.g., a length disclosed herein;

iv. the Cas9 molecule is a protein selected from Table III.1, e.g., a Cas9 molecule other than a *S. pyogenes* Cas9 molecule, or a Cas9 molecule, other than an *S. pyogenes* Cas9 molecule, comprising at least 20, 30, 40, 50, 55, 60, 65, 70, 75, 80, 85, 90, 95, 99, or 100% homology with, or which differs by no more than 1, 2, 3, 4, 5, 6, 7, 8, 9, 10, 15, 20, 25, 30, 35, 40, 35, 50, 55, 60, 65, 70, 75, 80, 85, 90, 95, 100, 150, 200, 250, 300, 350 or 400, amino acid residues from, the amino acid sequence of a reference sequences, e.g., naturally occurring Cas9 molecule, e.g., a Cas9 molecule described in Table III.1 herein;

v. the Cas9 system further comprises a second Cas9 molecule;

vi. the Cas9 molecule is less than about 1300 amino acids in length;

vii. the Cas9 molecule comprises a heterologous PI domain;

viii. the Cas9 molecule comprises a REC2 deletion, $REC1_{CT}$ deletion, or a $REC1_{SUB}$ deletion, or any combination thereof;

ix. the template nucleic acid has a preselected sequence comprising a 5' homology arm, a replacement sequence, and a 3' homology arm, wherein the replacement sequence corresponds to an endogenous nucleic acid, e.g., a chromosomal or organellar nucleic acid, e.g., are not part of a heterologous reporter gene; and x. the HDR-enhancer molecule is an antibody, e.g., an intrabody, a miRNA, a siRNA, e.g., an siRNA having a modified nucleotide, or an antiMiR.

xi. the HDR-enhancer molecule is an HDR-enhancing gRNA, e.g., a gRNA molecule designed to down-regulate non-HDR DNA repair pathways including, but not limited to, alt-NHEJ or c-NHEJ (see FIG. 1), or designed to up-regulate HDR DNA repair pathways including, but not limited to, SSA, alt-HR, or HR (see FIG. 1).

In some embodiments, one or more of properties (i)-(xi) is present. In some embodiments, one or more of properties (i), (ii), (iv), (v), (vi), (vii), (viii), (x) or (xi) is present. In some embodiments, one or more of properties (i), (ii), (v), (vi), (vii), (viii), (x), or (xi) is present.

In embodiments, the landmark is: (a) the target position, (b) the 5' end of a target position, (c) the 3' end of a target position, (d) within a target position, (e) a position on the target nucleic acid that corresponds to: the 5' end of the replacement sequence; the 3' end of the replacement sequence; the 5' end of the template nucleic acid; the 3' end of the template nucleic acid; within the 5' homology arm; within the 3' homology arm; or within the replacement sequence, or (f) an intron/exon boundary, e.g., the intron/exon boundary nearest the target position or within 50, 100 or 200 nucleotides of the target position; (g) in an intron, e.g., the intron nearest to the target position, the intron within which the target position lies, the nearest intron upstream of the target position, the nearest intron downstream of the target position, or an intron within 50, 100, 200, or 500 nucleotides of the target position; (h) in an exon, e.g., the exon nearest to the target position, the exon within which the target position lies, the nearest exon upstream of the target position, the nearest exon downstream of the target position, or an exon within 50, 100, 200, or 500 nucleotides of the target position; (i) the 5' end of a coding region, e.g., the coding region nearest to the target position, the coding region within which the target position lies, the nearest coding region upstream of the target position, the nearest coding region downstream of the target position, or a coding region within 50, 100, 200, or 500 nucleotides of the target position; (j) the 3' end of a coding region, e.g., the coding region nearest to the target position, the coding region within which the target position lies, the nearest coding region upstream of the target position, the nearest coding region downstream of the target position, or a coding region within 50, 100, 200, or 500 nucleotides of the target position; (k) within a coding region, e.g., the coding region nearest to the target position, the coding region within which the target position lies, the nearest coding region upstream of the target position, the nearest coding region downstream of the target position, or a coding region within 50, 100, 200, or 500 nucleotides of the target position; (l) the 5' end of a transcribed region, e.g., the transcribed region nearest to the target position, the transcribed region within which the target position lies, the nearest transcribed region upstream of the target position, the nearest transcribed region downstream of the target position, or a transcribed region within 50, 100, 200, or 500 nucleotides of the target position; (m) the 3' end of a transcribed region, e.g., the transcribed region nearest to the target position, the transcribed region within which the target position lies, the nearest transcribed region upstream of the target position, the nearest transcribed region downstream of the target position, or a transcribed region within 50, 100, 200, or 500 nucleotides of the target position; (n) within a transcribed region, e.g., the transcribed region nearest to the target position, the transcribed region within which the target position lies, the nearest transcribed region upstream of the target position, the nearest transcribed region downstream of the target position, or a transcribed region within 50, 100, 200, or 500 nucleotides of the target position; (o) the 5' end of a repeated element, e.g., the repeated element nearest to the target position, the repeated element within which the target position lies, the nearest repeated element upstream of the target position, the nearest repeated element downstream of the target position, or a repeated element within 50, 100, 200, or 500 nucleotides of the target position; (p) the 3' end of a repeated element, e.g., the repeated element nearest to the target position, the repeated element within which the target position lies, the nearest repeated element upstream of the target position, the nearest repeated element downstream of the target position, or a repeated element within 50, 100, 200, or 500 nucleotides of the target position; or (q) within a repeated element, e.g., the repeated element nearest to the target position, the repeated element within which the target position lies, the nearest repeated element upstream of the target position, the nearest repeated element downstream of the target position, or a repeated element within 50, 100, 200, or 500 nucleotides of the target position.

In embodiments, the target position is in a naturally occurring fusion protein, e.g., an oncogenic fusion of two genes, e.g., BCR-ABL, TEL-AML1, AML1-ETO, or TMPRSS2-ERG. In some embodiments, the target position is in a gene, e.g., a naturally occurring gene, e.g., a gene that is wild-type or is carrying a naturally-occurring mutation.

In embodiments, the preselected position is selected from at the landmark, away from the landmark; within 50, 100, 150, or 200 nucleotides of the landmark; at least 10, 20, 30, 40, or 50 nucleotides away from the landmark; and 10 to 200, 20-200, 30-200, 40-200, 50-200, 10-150, 10-100, or 10-50 nucleotides from the landmark.

In embodiments, the landmark is a target position and the preselected position is selected from: at the landmark, away from the landmark; within 50, 100, 150, or 200 nucleotides of the landmark; at least 10, 20, 30, 40, or 50 nucleotides away from the landmark; and 10 to 200, 20-200, 30-200, 40-200, 50-200, 10-150, 10-100, or 10-50 nucleotides from the landmark.

In embodiments, the at least one domain of a preselected length is a targeting domain which is 12-30 nucleotides in length. In some embodiments, the at least one domain of a preselected length is a targeting domain which is at least 21 nucleotides in length, e.g., 21-30 nucleotides in length. In embodiments, the at least one domain of a preselected length is a domain encompassing the proximal domain and the tail domain, which taken together are at least 15, 18, 20, 25, 30, 31, 35, 40, 45, 49, 50, or 53 nucleotides in length.

In embodiments, the 5' homology arm or 3' homology arm, each independently has, or both have, a length of: at least 50, 100, 250, 500, 750, 1000, 2000, 3000, 4000, or 5000 nucleotides; no more than 50, 100, 250, 500, 750, 1000, 2000, 3000, 4000, or 5000 nucleotides; or between 50-100, 100-250, 250-500, 500-750, 750-1000, 1000-2000, 2000-3000, 3000-4000, or 4000-5000 nucleotides. In some embodiments, a 5' or 3' homology arm of a ssDNA template nucleic acid is 60-200 nucleotides. In some embodiments, a 5' or 3' homology arm of a dsDNA template nucleic acid is 500-4000 nucleotides. In embodiments, the 5' homology arm has a 5' end and a 3' end and: the 5' end is at least 50, 100, 250, 500, 750, 1000, 2000, 3000, 4000, or 5000 nucleotides from the target position, the 5' end is no more than 50, 100, 250, 500, 750, 1000, 2000, 3000, 4000, or 5000 nucleotides from the target position, the 5' end between 50-100, 100-250, 250-500, 500-750, 750-1000, 1000-2000, 2000-3000, 3000-4000, or 4000-5000 nucleotides from the target position, the 3' end is at least 50, 100, 250, 500, 750, 1000, 2000, 3000, 4000, or 5000 nucleotides from the target position, the 3' end is no more than 50, 100, 250, 500, 750, 1000, 2000, 3000, 4000, or 5000 nucleotides from the target position, or the 3' end between 50-100, 100-250, 250-500, 500-750, 750-1000, 1000-2000, 2000-3000, 3000-4000, or 4000-5000 nucleotides from the target position. In embodiments, the 3' homology arm has a 5' end and a 3' end and: the 5' end is at least 50, 100, 250, 500, 750, 1000, 2000, 3000, 4000, or 5000 nucleotides from the target position, the 5' end is no more than 50, 100, 250, 500, 750, 1000, 2000, 3000, 4000, or 5000 nucleotides from the target position, the 5' end between 50-100, 100-250, 250-500, 500-750, 750-1000, 1000-2000, 2000-3000, 3000-4000, or 4000-5000 nucleotides from the target position, the 3' end is at least 50, 100, 250, 500, 750, 1000, 2000, 3000, 4000, or 5000 nucleotides from the target position, the 3' end is no more than 50, 100, 250, 500, 750, 1000, 2000, 3000, 4000, or 5000 nucleotides from the target position, or the 3' end between 50-100, 100-250, 250-500, 500-750, 750-1000, 1000-2000, 2000-3000, 3000-4000, or 4000-5000 nucleotides from the target position. In embodiments, the replacement sequence has a length of: at least 1, 2, 3, 5, 10, 20, 50, 100, or 200 nucleotides, no more than 2, 3, 5, 10, 20, 50, 100, 200, or 500 nucleotides, or between 1-3, 1-5, 1-10 10-20, 20-50, 50-100, 100-200, or 200-500 nucleotides.

7. Further Method Steps

In embodiments, the method comprises contacting the cell with a Cas9 system as described herein. In embodiments, the method comprises contacting the cell with a vector as described herein. In embodiments, altering the structure of a cell comprises altering the structure of a target nucleic acid of the cell. In embodiments, the sequence of the target nucleic acid is altered. In embodiments, a deletion is created in the target nucleic acid. In embodiments, a mutant or disease phenotype is converted to a non-mutant or non-disease phenotype.

In embodiments, altering the structure of the target nucleic acid comprises HDR-mediated repair, such as alt-HR mediated repair, SSA-mediated repair, or HR-mediated repair. In embodiments, the efficiency of HDR is increased over the level seen in the absence of an HDR-enhancer. In embodiments, altering the structure of the target nucleic acid comprises creating a break in the target nucleic acid, e.g., a single or double strand break. In embodiments, the double strand break is blunt-ended or comprises one or two overhangs. In embodiments, altering the structure of the target nucleic acid comprises resection, e.g., at a single or double strand break.

In embodiments, the chromatin at the target nucleic acid is altered. In embodiments, the method further comprises assaying cell chromatin state of the cell, e.g., chromatin state of the target nucleic acid.

In embodiments, the method further comprises assaying cell cycle status of the cell, e.g., determining whether the cell is in G2 phase.

In embodiments, the method further comprises contacting the cell with an additional one or more HDR-enhancers, e.g., contacting the cell with exactly two or exactly three HDR-enhancers. In embodiments, the HDR-enhancer and the additional HDR-enhancer (i) up-regulate the same pathway, or (ii) down-regulate the same pathway.

In embodiments, the method further comprises contacting the cell with a second gRNA. In embodiments, the gRNA guides the Cas9 molecule to produce a first break, and a second gRNA guides a second Cas9 molecule to produce a second break. In embodiments, the first break is a single strand break and the second break is a single strand break, the first break is a single strand break and the second break is a double strand break, the first break is a double strand break and the second break is a single strand break, or the first break is a double strand break and the second break is a double strand break.

In embodiments, the method further comprises contacting the cell with a second Cas9 molecule. In embodiments, the Cas9 molecule is a nickase and the second Cas9 molecule is a nickase; the Cas9 molecule can catalyze a double strand break and the second Cas9 molecule is a nickase; the Cas9 molecule is a nickase and the second Cas9 molecule can catalyze a double strand break; or the Cas9 molecule can catalyze a double strand break and the second Cas9 molecule can catalyze a double strand break.

In embodiments, the gRNA targets the Cas9 molecule to make a first break and a second gRNA targets a second Cas9 molecule to make a second break. In embodiments, the two breaks are positioned: within 55 nucleotides of one another; at least 25 nucleotides apart; or within 25-65 nucleotides of one another. In embodiments, the first break is a single strand break and the second break is a single strand break; the first break is a single strand break and the second break is a double strand break; the first break is a double strand break and the second break is a single strand break; or the first break is a double strand break and the second break is a double strand break. In embodiments, the Cas9 molecule targeted by the gRNA has the same structure, e.g., amino acid sequence, as the Cas9 molecule targeted by the second gRNA. In embodiments, the Cas9 molecule targeted by the gRNA has a different structure, e.g., amino acid sequence, as the Cas9 molecule targeted by the second gRNA. In embodiments, the Cas9 molecule creates a first break in at a first target position and the second Cas9 molecule creates a second break at a second target position.

In embodiments, the method forms a double-stranded break that is blunt-ended. In embodiments, the method forms a double strand break that comprises one or two overhangs.

In embodiments, the method further comprises contacting the cell with a cell cycle arrest agent. In embodiments, the cell cycle arrest agent arrests cells in G2. In embodiments, the cell cycle arrest agent is a Cdk1 inhibitor. In embodiments, the cell cycle arrest agent is not a Cdk1 inhibitor. In embodiments, the cell cycle arrest agent is an agent of Table VIII.

In embodiments, the method further comprises a step of removing the cell from a subject's body before contacting the cell with the gRNA, the Cas9 molecule, the template nucleic acid, and the HDR-enhancer. In embodiments, the method further comprises a step of returning the cell to the subject's body after contacting the cell with the gRNA, the Cas9 molecule, the template nucleic acid, and the HDR-enhancer. In embodiments, the method further comprises a step of placing the cell in a subject's body after contacting the cell with the gRNA, the Cas9 molecule, the template nucleic acid, and the HDR-enhancer.

In embodiments, contacting the cell with the gRNA comprises contacting the cell with DNA comprising the sequence of the gRNA, and allowing the cell to produce gRNA. In embodiments, contacting the cell with the Cas9 molecule comprises contacting the cell with a nucleic acid (e.g., DNA or RNA) encoding the Cas9 molecule, and allowing the cell to produce the Cas9 molecule. In embodiments, contacting the cell with the HDR-enhancer comprises contacting the cell with a nucleic acid (e.g., DNA or RNA) encoding the HDR-enhancer, and allowing the cell to produce the HDR-enhancer. In embodiments, contacting the cell with the Cas9 molecule, the gRNA, the template nucleic acid, and the HDR-enhancer comprises contacting the cell with a recombinant nucleic acid that comprises or encodes two of the Cas9 molecule, the gRNA, the template nucleic acid, and the HDR-enhancer, e.g., encodes the Cas9 molecule and encodes or comprises the gRNA, encodes the Cas9 molecule and comprises the template nucleic acid, encodes the Cas9 molecule and encodes or comprises the HDR-enhancer, encodes or comprises the gRNA and comprises the template nucleic acid, encodes or comprises the gRNA and encodes or comprises the HDR-enhancer, or comprises the template nucleic acid and encodes or comprises the HDR-enhancer, and allowing the cell to produce the two of the Cas9 molecule, the gRNA the template nucleic acid, and the HDR-enhancer. In embodiments, contacting the cell with the Cas9 molecule, the gRNA, the template nucleic acid, and the HDR-enhance comprises contacting the cell with a recombinant nucleic acid that comprises or encodes at least three, e.g., all, of the Cas9 molecule, the gRNA, the template nucleic acid, and the HDR-enhancer, e.g.: encodes the Cas9 molecule, encodes or comprises the gRNA, and comprises the template nucleic acid; encodes the Cas9 molecule, encodes or comprises the gRNA, and encodes or comprises the HDR-enhancer; encodes the Cas9 molecule, comprises the template nucleic acid, and encodes or comprises the HDR-enhancer; encodes or comprises the gRNA, comprises the template nucleic acid, and encodes or comprises the HDR-enhancer, or encodes the Cas9 molecule, encodes or comprises the gRNA, comprises the template nucleic acid, and encodes or comprises the HDR-enhancer, and allowing the cell to produce the gRNA and the Cas9 molecule.

In embodiments, the cell is contacted with the HDR-enhancer after being contacted with one or more of the gRNA, the Cas9 molecule, and the template nucleic acid. In embodiments, the cell is contacted with the HDR-enhancer before being contacted with one or more of the gRNA, the Cas9 molecule, and the template nucleic acid. In embodiments, the cell is contacted with the gRNA, the Cas9 molecule, the template nucleic acid, and the HDR-enhancer at substantially the same time. In embodiments, the cell is contacted with the gRNA and the Cas9 molecule at substantially the same time.

In embodiments, the target position is altered to take the sequence of at least a portion of the template nucleic acid, e.g., the replacement sequence or a portion thereof.

In embodiments, administering the gRNA comprises administering DNA encoding the gRNA; administering the Cas9 molecule comprises administering DNA or RNA encoding the Cas9 molecule; or administering the gRNA and Cas9 molecules comprises administering a recombinant nucleic acid that encodes both the gRNA and the Cas9 molecule, or any combination thereof.

In embodiments, the HDR-enhancer molecule is administered separately from the gRNA or the Cas9 molecule.

In embodiments, the method comprises a step of removing the cell from a subject's body before contacting the cell with the gRNA, the Cas9 molecule, the template nucleic acid, and the HDR-enhancer, and further comprising a step of returning the cell to the subject's body after contacting the cell with the gRNA, the Cas9 molecule, the template nucleic acid, and the HDR-enhancer.

In embodiments, only one DNA repair pathway is substantially down-regulated or only one inhibitor is contacted with the cell. In embodiments, two DNA repair pathways are substantially downregulated when only one inhibitor is contacted with the cell. In embodiments, three DNA repair pathways are substantially downregulated when only one inhibitor is contacted with the cell.

In embodiments, the cell is in G1 phase: at the time the cell is contacted with the Cas9 system at the time a Cas9 molecule cleaves a target position, or at the time a Cas9 molecule-mediated break is repaired by HDR. In embodiments, the cell is in S phase: at the time the cell is contacted with the Cas9 system; at the time a Cas9 molecule cleaves a target position, or at the time a Cas9 molecule-mediated break is repaired by HDR.

8. Characteristics of the Subject

In embodiments, the subject has a disorder that is caused by a target position in a target nucleic acid. In embodiments, the disorder is cancer, a genetic disease, an infectious disease, a disorder caused by aberrant mtDNA, a metabolic disease, a disorder caused by aberrant cell cycle, a disorder caused by aberrant angiogenesis, a disorder caused by aberrant DNA damage repair, or a pain disorder. In one embodiment, the subject is a human subject.

9. Characteristics of Nucleic Acid Compositions

In embodiments, the Cas9 system comprises one or more of: a nucleic acid encoding a gRNA suitable for targeting a Cas9 molecule to a target nucleic acid in a cell; a nucleic acid encoding a Cas9 molecule; and a nucleic acid that encodes the HDR-enhancer.

In embodiments, nucleic acid encoding a gRNA suitable for targeting a Cas9 molecule to a target nucleic acid in a cell is DNA. In embodiments, the nucleic acid encoding a Cas9 molecule is DNA. In embodiments, the nucleic acid that encodes the HDR-enhancer molecule is DNA. In embodiments, the Cas9 system comprises a template nucleic acid, which template nucleic acid is optionally DNA.

In embodiments, the composition further comprises a nucleic acid that comprises or encodes a second gRNA. In embodiments, the composition further comprises a nucleic acid that encodes a second Cas9 molecule. In embodiments, the composition further comprises a nucleic acid that comprises or encodes a second HDR-enhancer. In embodiments, the composition further comprises a nucleic acid that comprises or encodes a third HDR-enhancer.

In embodiments, the HDR-enhancer molecule is a protein. In embodiments, the HDR-enhancer molecule is an RNA. In other embodiments, the HDR-enhancer molecule is an HDR-enhancing gRNA molecule.

In embodiments, each nucleic acid is a DNA. In embodiments, the nucleic acid molecule encoding the gRNA molecule, and the nucleic acid molecule encoding the Cas9 molecule are disposed on a single nucleic acid molecule. In other embodiments, the nucleic acid molecule encoding the gRNA molecule, and the nucleic acid molecule encoding the Cas9 molecule are disposed on separate nucleic acid molecules. In one embodiment, the nucleic acid molecule encoding the gRNA molecule, and the nucleic acid molecule encoding the template nucleic acid are disposed on a single nucleic acid molecule. In one embodiment, the nucleic acid molecule encoding the gRNA molecule, and the nucleic acid molecule encoding the template nucleic acid are disposed on separate nucleic acid molecules. In another embodiment, the nucleic acid encoding the Cas9 molecule and the nucleic acid encoding the template nucleic acid are disposed on a single nucleic acid molecule. In another embodiment, the nucleic acid encoding the Cas9 molecule and the nucleic acid encoding the template nucleic acid are disposed on separate nucleic acid molecules. In another embodiment, the nucleic acid encoding the gRNA molecule, the nucleic acid encoding the Cas9 molecule, and the template nucleic acid are disposed on a single nucleic acid molecule. In another embodiment, the nucleic acid encoding the gRNA molecule and the nucleic acid encoding the Cas9 molecule are disposed on a single nucleic acid molecule and the template nucleic acid is disposed on a separate nucleic acid molecule. In another embodiment, the nucleic acid encoding the gRNA molecule and the template nucleic acid are disposed on a single nucleic acid molecule and the nucleic acid encoding the Cas9 molecule is disposed on a separate nucleic acid molecule. In another embodiment, the nucleic acid encoding the Cas9 molecule and the template nucleic acid are disposed on a single nucleic acid molecule and the nucleic acid encoding the gRNA molecule is disposed on a separate nucleic acid molecule. In yet another embodiment, the nucleic acid encoding the gRNA molecule, the nucleic acid encoding the Cas9 molecule, and the template nucleic acid are each disposed on separate nucleic acid molecules.

In embodiments, each nucleic acid forms part of a single nucleic acid molecule. In embodiments, each nucleic acid forms part of a single circular double stranded DNA. In embodiments, each nucleic acid forms part of a linear double stranded DNA.

In embodiments, the composition is a purified composition.

10. Additional Characteristics

In one embodiment, described herein is a cell comprising a Cas9 system described herein. In one embodiment, described herein is a population of cells, each of which comprise a Cas9 system described herein. In one embodiment, described herein is a kit comprising a Cas9 system described herein. In one embodiment, the kit comprises a composition described herein. In another embodiment, the kit comprises a cell or a population of cells described herein.

In one embodiment, described herein is a composition comprising a Cas9 system. In embodiments, the composition further comprises a pharmaceutically acceptable excipient. In embodiments, the gRNA molecule and the Cas9 molecule form part of a single admixture or are provided separately; the gRNA molecule and the HDR-enhancer molecule form part of a single admixture or are provided separately; the gRNA molecule and the template nucleic acid form part of a single admixture or are provided separately; the Cas9 molecule and the HDR-enhancer molecule form part of a single admixture or are provided separately; the Cas9 molecule and the template nucleic acid form part of a single admixture or are provided separately; the HDR-enhancer molecule and the template nucleic acid form part of a single admixture or are provided separately; the gRNA molecule, the Cas9 molecule, and the HDR-enhancer molecule form part of a single admixture or are provided separately; the gRNA molecule, the Cas9 molecule, and the template nucleic acid form part of a single admixture or are provided separately; the Cas9 molecule, the HDR-enhancer molecule, and the template nucleic acid form part of a single admixture or are provided separately; or the gRNA molecule, the Cas9 molecule, the HDR-enhancer molecule, and the template nucleic acid form part of a single admixture or are provided separately.

In embodiments, the Cas9 system comprises a kit. The kit may further comprise packaging. The kit may further comprise instructions for use to treat a disorder, e.g., a disorder caused by a target position in a target nucleic acid. In embodiments, the gRNA molecule and the Cas9 molecule form part of a single admixture or are provided separately; the gRNA molecule and the HDR-enhancer molecule form part of a single admixture or are provided separately; the gRNA molecule and the template nucleic acid form part of a single admixture or are provided separately; the Cas9 molecule and the HDR-enhancer molecule form part of a single admixture or are provided separately; the Cas9 molecule and the template nucleic acid form part of a single admixture or are provided separately; the HDR-enhancer molecule and the template nucleic acid form part of a single admixture or are provided separately; the gRNA molecule, the Cas9 molecule, and the HDR-enhancer molecule form part of a single admixture or are provided separately; the gRNA molecule, the Cas9 molecule, and the template nucleic acid form part of a single admixture or are provided separately; the Cas9 molecule, the HDR-enhancer molecule, and the template nucleic acid form part of a single admixture or are provided separately; or the gRNA molecule, the Cas9 molecule, the HDR-enhancer molecule, and the template nucleic acid form part of a single admixture or are provided separately.

In embodiments, the Cas9 system further comprises a cell cycle arrest agent. The cell cycle arrest agent may be capable of arresting cells in G2 phase. In embodiments, the cell cycle arrest agent is a Cdk1 inhibitor. In embodiments, the inhibitor is an HDR-enhancing gRNA molecule, a small molecule, an siRNA, or an antibody, e.g., intrabody, directed against Cdk1. In embodiments, the cell cycle arrest agent is not a Cdk1 inhibitor.

In embodiments, one or a plurality of components, e.g., the gRNA molecule and the template nucleic acid, are provided as a single admixture. In embodiments, one or a plurality of components, e.g., the gRNA molecule and the template nucleic acid, are each provided separately from one another, e.g., as different solutions.

The disclosure contemplates all combinations of any one or more of the foregoing aspects and/or embodiments, as well as combinations with any one or more of the embodiments set forth in the detailed description and examples.

Unless otherwise defined, all technical and scientific terms used herein have the same meaning as commonly understood by one of ordinary skill in the art to which this invention belongs. Although methods and materials similar or equivalent to those described herein can be used in the practice or testing of the present invention, suitable methods and materials are described below. All publications, patent applications, patents, and other references mentioned herein are incorporated by reference in their entirety. In addition, the materials, methods, and examples are illustrative only and not intended to be limiting.

Headings, including numeric and alphabetical headings and subheadings, are for organization and presentation and are not intended to be limiting.

Other features and advantages of the invention will be apparent from the detailed description, drawings, and from the claims.

BRIEF DESCRIPTION OF THE DRAWINGS

The drawings are first briefly described.

FIG. 1 is a model representing the DNA repair pathways activated in response to a double-stranded break (DSB).

FIG. 2 is a cartoon depicting the different Cas9 variants and their positioning using a single gRNA or dual gRNAs.

FIG. 3 is a graph depicting that a Cas9 mutated in the RUVC domain with a PAM in the opposite orientation leaves a 5' protruding end that is more prone to be engaged in HR (gene conversion) in the absence of a donor template nucleic acid. The data is a representation of at least four independent experiments with a minimum of 350 reads per condition.

FIG. 4 is a graph depicting that a Cas9 mutated in the RUVC domain with a Pam facing in the opposite orientation leaves a 5' protruding end that is more prone to be engaged in HDR in the presence of a single-stranded oligonucleotide donor template nucleic acid. The data is a representation of at least four independent experiments with a minimum of 350 reads per condition.

FIG. 5 is a graph depicting that 60% of the gene editing events using wild-type Cas9 (black) resolve in small deletions, typically a signature of c-NHEJ.

FIG. 6 is a graph depicting that double strand breaks (DSB) generated by wild-type Cas9 are predominantly repaired by canonical NHEJ (c-NHEJ).

FIGS. 7A and 7B are graphs depicting that the down-regulation of Artemis leads to an increase in gene correction mediated by a single-stranded oligonucleotide donor (ss-ODN). FIG. 7A depicts a western blot showing down-regulation of Artemis. FIG. 7B depicts quantification of the gene conversion using a single stranded oligonucleotide donor, wild-type Cas9, and gRNAs HBB-8 and HBB-15 against the HBB locus.

FIG. 8 is a western blot showing the down-regulation of Rad80 using siRNA.

FIG. 9 is a model depicting that double-stranded breaks generated by the N863A Cas9 mutant are predominantly are paired by Alt-NHEJ.

FIG. 10 is a graph depicting that the down-regulation of Pol Theta leads to an increase in gene conversion and a decrease in insertions.

FIG. 11 is a model depicting that double-stranded breaks generated by the D10A Cas9 mutant are predominantly repaired by HR.

FIGS. 12A and 12B depict that gene conversions and non-gene correction is dependent on HR. Specifically, FIG. 12A is a western blot showing BRAC2 and Rad51 down-regulation. FIG. 12B is a graph depicting the percentage of modification observed in U2OS cells edited at the HBB locus with D10A Cas9 and 2 gRNAs with or without BRCA2 or Rad51. FF is a negative control.

FIG. 13A is a Western blot showing down-regulation of Rad52 and ERCC1. FIG. 13B is a graph depicting the effect of down-regulation of Rad52 and ERCC1 on gene correction at the HBB locus in response to a 5' protruding double strand break generated with the D10A Cas9 mutant.

FIGS. 14A and 14B depict that gene conversion is dependent on EXO1. The left panel of FIG. 14A is a western blot panel showing down-regulation of EXO1 with siRNA. The right panel of FIG. 14A is a western blot showing the levels of Exo1 in cell lines that have been generated by expression of the gRNA and S.a. FIG. 14B shows two graphs depicting the effect of the down-regulation of Exo1 on gene conversion in response to a 5' protruding double-stranded break generated with the D10A Cas9 mutant.

FIG. 15 is a model depicting the inbition of chromatin modification.

DEFINITIONS

Figure 13A:
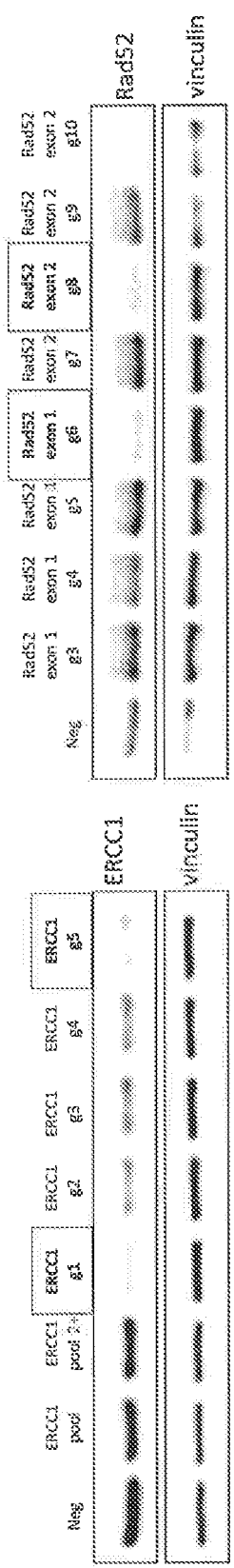
FIGS. 13A and 13B demonstrate that gene correction is dependent on SSA.

"Altered PI domain", as that term is used herein, refers to a PAM-interacting (PI) domain other than the native or endogenous PI domain associated with the naturally occurring Cas9 molecule. For example, a Cas9 molecule comprises an altered PI domain if its PI domain is other than the PI domain naturally associated with the Cas9 core domain of the Cas9 molecule, or if its PI domain is not a naturally occurring PI domain associated with any Cas9 molecule. (Derived, as used in this sense, is not limited to physical derivation or even derivation from a specific source, and does not require a process limitation, but in an embodiment, includes mere structural similarity). An altered PI domain may have less than 99, 98, 97, 96, 95, 94, 93, 92, 91, 90, 89, 88, 87, 86, 85, 84, 83, 82, 81, 80, 70, 60, 50, 30, 40, 30, 20, or 10% homology with the native or endogenous PI domain of a subject naturally occurring Cas9 molecule from which the Cas9 core domain is derived. An altered PI domain may have a different RKR motif (the PAM recognition sequence) than that of the native or endogenous PI domain of the Cas9 species that supplies the Cas9 core domain. The RKR motif of an altered PI domain may differ from the RKR motif of the native or endogenous PI domain of the Cas9 core domain by 1, 2, or 3 residues. The RKR motif of the altered PI differs at the first position, the second position, the third position, the first and second positions, the first and third positions, the second and third positions, or all three positions, from the RKR motif of the PI endogenous to or naturally associated with the Cas9 core domain. In an embodiment, an altered PI domain is one having greater homology with the PI domain of a reference or donor naturally occurring Cas9 molecule (a heterologous Cas9) that with the native PI domain of a subject Cas9.

"ALT-HR" or "alternative HR", or alternative homology repair pathway, as used herein, refers to the process of repairing DNA damage using a homologous nucleic acid (e.g., a sister chromatid or an exogenous nucleic acid, e.g., a template nucleic acid). ALT-HR is distinct from HR in that the process utilizes different pathways from canonical HR, and can be inhibited by the HR mediators, RAD51 and BRCA2. Also, ALT-HR uses a single-stranded or nicked homologous nucleic acid for repair of the break.

"ALT-NHEJ" or "alternative NHEJ", or alternative non-homologous end joining, as used herein, is a type of alternative end joining repair process, and utilizes a different pathway than that of canonical NHEJ. In alternative NHEJ, a small degree of resection occurs at the break ends on both sides of the break to reveal single-stranded overhangs. Ligation or annealing of the overhangs results in the deletion of sequence. ALT-NHEJ is a category that includes micro-homology-mediated end joining (MMEJ), blunt end joining (EJ), and SD-MMEJ (see FIG. 1). In MMEJ, microhomologies, or short spans of homologous sequences, e.g., 5 nucleotides or more, on the single-strand are aligned to guide repair, and leads to the deletion of sequence between the microhomologies.

"Amino acids" as used herein encompasses the canonical amino acids as well as analogs thereof.

"Amino acid residues that flank a deletion", as that phrase is used herein, refers to the amino acid residue that immediately precedes the deletion and the amino acid residue that immediately follows the deletion. By way of example, in a sequence $_{CT}1$-$_{CT}2$-$_{CT}3$-$_{CT}7$-$_{CT}8$-$_{CT}9$, wherein $_{CT}4$-$_{CT}5$-$_{CT}6$ is deleted, the flanking amino acid residues are, $_{CT}3$ and $_{CT}7$.

As used herein, an agent that promotes cell cycle "arrest" refers to an agent that causes a cell to cease dividing and to remain in a characteristic phase of the cell cycle. For instance, the agent may cause the cell to arrest in G1 or G2.

In embodiments, the agent produces a reversible cell cycle arrest, such that the cell resumes dividing once the agent is withdrawn.

"Canonical NHEJ", or canonical non-homologous end joining, as used herein, refers to the process of repairing double strand breaks in which the break ends are directly ligated. This process does not require a homologous nucleic acid to guide the repair, and can result in deletion or insertion of one or more nucleotides. This process requires the Ku heterodimer (Ku70/Ku80), the catalytic subunit of DNA-PK (DN-PKcs), and/or DNA ligase XRCC4/LIG4.

"Cas9 molecule," as that term is used herein, refers to a Cas9 polypeptide or a nucleic acid encoding a Cas9 polypeptide. A Cas9 polypeptide is a polypeptide that can bind (1) a PAM (a protospacer adjacent motif) in a nucleic acid and (2) a guide RNA (gRNA) molecule. In an embodiment, in concert with the gRNA molecule, a Cas9 polypeptide can localize to a site which comprises a target domain.

A Cas9 molecule may be a nuclease (an enzyme that cleaves both strands of a double-stranded nucleic acid), a nickase (an enzyme that cleaves one strand of a double-stranded nucleic acid), or an enzymatically inactive (or dead) Cas9 molecule. A Cas9 molecule having nuclease or nickase activity is referred to as an "enzymatically active Cas9 molecule" (an "eaCas9" molecule). A Cas9 molecule lacking the ability to cleave target nucleic acid is referred to as an "enzymatically inactive Cas9 molecule" (an "eiCas9" molecule). A Cas9 molecule can have the amino acid sequence of a naturally occurring Cas9 molecule or can be an altered, engineered or modified Cas9 molecule, which differs by at least one amino acid residue, from a reference sequence, e.g., the most similar naturally occurring Cas9 molecule, e.g., a Cas9 molecule from Table III.1. (The terms altered, engineered or modified, as used in this context, refer merely to a difference from a reference or naturally occurring sequence, and impose no specific process or origin limitations.) A Cas9 molecule may be a Cas9 polypeptide or a nucleic acid encoding a Cas9 polypeptide.

In an embodiment, a Cas9 molecule meets one or both of the following criteria: it has at least 20, 30, 40, 50, 55, 60, 65, 70, 75, 80, 81, 82, 83, 84, 85, 86, 87, 88, 89, 90, 91, 92, 93, 94, 95, 96, 97, 98, 99, or 100% homology with, or it differs by no more than 1, 2, 3, 4, 5, 6, 7, 8, 9, 10, 11, 12, 13, 14, 15, 16, 17, 18, 19, 20, 25, 30, 35, 40, 35, 50, 55, 60, 65, 70, 75, 80, 85, 90, 95, 100, 150, 200, 250, 300, 350 or 400, amino acid residues from, the amino acid sequence of a reference sequences, e.g., naturally occurring Cas9 molecule, e.g., a Cas9 molecule described in Table III.1 herein.

In one embodiment, the Cas9 molecule may be a Cas9 deletion, e.g., the Cas9 may comprise a deletion in one or more of the following domains: a REC2, REC1$_{CT}$, or REC1$_{SUB}$ domain, and optionally, a linker disposed between the amino acids flanking the deletion. Except for any REC deletion and associated linker, a Cas9 molecule meets one or both of the following criteria: it has at least 20, 30, 40, 50, 55, 60, 65, 70, 75, 80, 81, 82, 83, 84, 85, 86, 87, 88, 89, 90, 95, 99, or 100% homology with, or it differs by no more than 1, 2, 3, 4, 5, 6, 7, 8, 9, 10, 11, 12, 13, 14, 15, 16, 17, 18, 19, 20, 25, 30, 35, 40, 35, 50, 55, 60, 65, 70, 75, 80, 85, 90, 95, 100, 150, 200, 250, 300, 350 or 400, amino acid residues from, the amino acid sequence of a reference sequences, e.g., naturally occurring Cas9 molecule, e.g., a Cas9 molecule described in Table III.1 herein. Homology except for any REC deletion is determined as follows: a sequence having a deletion is altered by replacing the deleted sequence with the corresponding sequence from the reference sequence, and the altered sequence is compared with the reference sequence.

In another embodiment, the Cas9 molecule may be a Cas9 variant, e.g., the Cas9 molecule may comprise an altered PI domain, or other modified amino acid sequence, or the Cas9 molecule may comprise a linker. In an alternate embodiment, except for an altered PI domain or other modified amino acid sequence, a Cas9 molecule meets one or both of the following criteria: it has at least 20, 30, 40, 50, 55, 60, 65, 70, 75, 80, 81, 82, 83, 84, 85, 86, 87, 88, 89, 90, 91, 92, 93, 94, 95, 96, 97, 98, 99, or 100% homology with, or it differs by no more than 1, 2, 3, 4, 5, 6, 7, 8, 9, 10, 11, 12, 13, 14, 15, 16, 17, 18, 19, 20, 25, 30, 35, 40, 35, 50, 55, 60, 65, 70, 75, 80, 85, 90, 95, 100, 150, 200, 250, 300, 350 or 400, amino acid residues from, the amino acid sequence of a reference sequences, e.g., naturally occurring Cas9 molecule, e.g., a Cas9 molecule described in Table III.1 herein. Homology except for an altered PI domain, or other modified amino acid sequence is determined as follows: a sequence having an altered PI domain (or other modified amino acid sequence) is altered by restoring the altered PI domain (or other modified amino acid sequence) to the naturally occurring PI domain (or other naturally occurring sequence) from the reference sequence, and the thus altered sequence is compared with the reference sequence.

In an alternate embodiment, except for a linker, a Cas9 molecule meets one or both of the following criteria: it has at least 20, 30, 40, 50, 55, 60, 65, 70, 75, 80, 81, 82, 83, 84, 85, 86, 87, 88, 89, 90, 91, 92, 93, 94, 95, 96, 97, 98, 99, or 100% homology with, or it differs by no more than 1, 2, 3, 4, 5, 6, 7, 8, 9, 10, 11, 12, 13, 14, 15, 16, 17, 18, 19, 20, 25, 30, 35, 40, 35, 50, 55, 60, 65, 70, 75, 80, 85, 90, 95, 100, 150, 200, 250, 300, 350 or 400, amino acid residues from, the amino acid sequence of a reference sequences, e.g., naturally occurring Cas9 molecule, e.g., a Cas9 molecule described in Table III.1 herein. Homology except for a linker is determined as follows: a sequence having a linker is altered by omitting the linker sequence, and the thus altered sequence is compared with the reference sequence.

In another embodiment, each domain of the Cas9 molecule (e.g., the domains named herein), including any remaining portion of a REC2, REC1$_{CT}$, or REC1$_{SUB}$ domain having a deletion or an unaltered portion of a PI domain, will, independently have: at least 20, 30, 40, 50, 55, 60, 65, 70, 75, 80, 81, 82, 83, 84, 85, 86, 87, 88, 89, 90, 91, 92, 93, 94, 95, 96, 97, 98, 99, or 100% homology with such a domain described herein, e.g., in a species of Table III.1. In an embodiment at least 1, 2, 3, 4, 5, of 6 domains will have, independently, at least 50, 60, 70, 80, 81, 82, 83, 84, 85, 86, 87, 88, 89, 90, 91, 92, 93, 94, 95, 96, 97, 98, 99, or 100% homology with a corresponding domain, while any remaining domains will be absent, or have less homology to their corresponding naturally occurring domains.

In one embodiment, the Cas9 molecule is a *S. pyogenes* Cas9 variant. In certain embodiments, the Cas9 variant is the EQR variant. In certain embodiments, the Cas9 variant is the VRER variant. In certain embodiments, the eiCas9 molecule is a *S. pyogenes* Cas9 variant. In certain embodiments, the Cas9 variant is the EQR variant. In certain embodiments, the Cas9 variant is the VRER variant. In certain embodiments, a Cas9 system comprises a Cas9 molecule, e.g., a Cas9 molecule described herein, e.g., the Cas9 EQR variant or the Cas9 VRER variant.

In some embodiments, the Cas9 molecule is a *S. aureus* Cas9 variant. In certain embodiments, the Cas9 variant is the KKH (E782K/N968K/R1015H) variant (see Kleinstiver et al. (2015) NAT. BIOTECHNOL. doi: 10.1038/nbt.3404, the entire contents of which are expressly incorporated herein by reference). In some embodiments, the Cas9 variant is the E782K/K929R/R1015H variant (see Kleinstiver et al. (2015)). In some embodiments, the Cas9 variant is the E782K/K929R/N968K/R1015H variant (see Kleinstiver et al. (2015). In some embodiments the Cas9 variant comprises one or more mutations in one of the following residues: E782, K929, N968, R1015. In some embodiments the Cas9 variant comprises one or more of the following mutations: E782K, K929R, N968K, R1015H and R1015Q (see Kleinstiver et al. (2015)). In certain embodiments, a Cas9 system comprises a Cas9 molecule, e.g., a Cas9 molecule described herein, e.g., the Cas9 KKH variant.

"Cas9 polypeptide", as that term is used herein, also refers to a polypeptide having at least 80%, 85%, 90%, 95%, 96%, 97%, 98%, 99%, or 100% homology with a reference Cas9 molecule, e.g., a Cas9 molecule of Table III.1. A Cas9 polypeptide can be enzymatically active (an eaCas9 polypeptide), or can lack the ability to cleave a target nucleic acid (an eiCas9 polypeptide).

"Cas9 core domain", as that term is used herein, refers to a polypeptide that does not include a functional PI domain, e.g., a polypeptide not having an endogenous PI domain, e.g., wherein the endogenous PI domain is deleted (deleted, as used in this context, refers merely to a sequence difference or the absence of amino acid residues and implies no process or origin limitation), or generally, a Cas9 molecule lacking a PI domain. In an embodiment, a Cas9 core domain comprises a REC1 domain, a REC2 domain, a BH domain, a RuvC domain, and an HNH domain. A Cas9 core domain, together with an altered PI domain, comprises a functional Cas9 molecule.

In an embodiment, a species X Cas9 core domain has at least 20, 30, 40, 50, 60, 70, 80, 81, 82, 83, 84, 85, 86, 87, 88, 89, 90, 91, 92, 93, 94, 95, 96, 97, 98, 99, or 100% homology with the corresponding sequence of a reference sequence, e.g., a naturally occurring species X Cas9 core domain, e.g., from a Cas9 core domain from Table III.1. In an embodiment, each of a REC1 domain, a REC2 domain, a BH domain, a RuvC domain, and/or an HNH domain of a species X Cas9 core domain has, independently, at least 20, 30, 40, 50, 60, 70, 80, 81, 82, 83, 84, 85, 86, 87, 88, 89, 90, 91, 92, 93, 94, 95, 96, 97, 98, 99, or 100% homology with the corresponding sequence of a reference sequence, e.g., a naturally occurring species X Cas9 core domain, e.g., from a Cas9 core domain from Table III.1.

As used herein, the term "Cas9 system" refers to a system capable of altering a target nucleic acid by one of many DNA repair pathways. In one embodiment, the Cas9 system described herein promotes repair of the target nucleic acid via an HDR pathway. In one embodiment, a Cas9 system comprises a gRNA molecule and a Cas9 molecule. In another embodiment, a Cas9 system comprises a gRNA molecule, a Cas9 molecule, and an HDR-enhancer molecule. In one embodiment, a Cas9 system further comprises a second gRNA molecule. In one embodiment, the Cas9 molecule is fused to a transcription activator. In another embodiment, the Cas9 molecule is fused to a transcription repressor. In yet another embodiment, a Cas9 system comprises a gRNA molecule, a Cas9 nickase molecule, and a second gRNA molecule. In one embodiment, a Cas9 system further comprises a template nucleic acid.

"Derived from", as used herein, refers to the source or origin of a molecular entity, e.g., a nucleic acid or protein. The source of a molecular entity may be naturally-occurring, recombinant, unpurified, or a purified molecular entity. For example, a polypeptide that is derived from a second polypeptide comprises an amino acid sequence that is identical or substantially similar, e.g., is more than 50% homologous to, the amino acid sequence of the second protein. The derived molecular entity, e.g., a nucleic acid or protein, can comprise one or more modifications, e.g., one or more amino acid or nucleotide changes.

A disorder "caused by" a mutation, as used herein, refers to a disorder that is made more likely or severe by the presence of the mutation, compared to a subject that does not have the mutation. The mutation need not be the only cause of a disorder, i.e., the disorder can still be caused by the mutation even if other causes, such as environmental factors or lifestyle factors, contribute causally to the disorder. In embodiments, the disorder is caused by the mutation if the mutation is a medically recognized risk factor for developing the disorder, and/or if a study has found that the mutation contributes causally to development of the disorder.

"Domain", as used herein, is used to describe segments of a protein or nucleic acid. Unless otherwise indicated, a domain is not required to have any specific functional property.

A "down-regulator", as used herein, refers to an agent that directly decreases the activity of a specified biological pathway. Directly decreasing the activity of the pathway refers to the down-regulator binding to a component of that pathway (e.g., a protein that acts in the pathway or an mRNA encoding that protein) and decreasing the level or activity of that component, e.g., by decreasing the concentration or specific activity of that component. For example, a down-regulator may slow one of the steps of that pathway or decrease the level or activity of a component in that pathway. A down-regulator may be, e.g., an inhibitor of a protein in the pathway, or an siRNA or a gRNA that induces a reduction in the expression of a protein in the pathway. The pathway may be, e.g., a DNA damage repair pathway, for example, HDR. In an embodiment, the decreased level or activity is compared to what would be seen in the absence of the down-regulator.

As used herein, "error-prone" repair refers to a DNA repair process that has a higher tendency to introduce mutations into the site being repaired. For instance, alt-NHEJ and SSA are error-prone pathways; C-NHEJ is also error prone because it sometimes leads to the creation of a small degree of alteration of the site (even though in some instances C-NHEJ results in error-free repair); and HR, alt-HR, and SSA in the case of a single strand oligo donor are not error-prone.

As used herein, an "EPR enhancer" refers to an agent that enhances (e.g., increases the frequency or efficiency of) error-prone repair (EPR). In some embodiments, the EPR-enhancer acts on a target in a DNA damage repair pathway, e.g., alt-NHEJ or SSA. The EPR-enhancer may act on, e.g., inhibit, a protein or nucleic acid (e.g., a miRNA) that stimulates a non-error-prone form of DNA repair. The EPR-enhancer may be, e.g., a small molecule, a macromolecule, a protein, an antibody, a peptide, a nucleic acid, a siRNA, an EPR-enhancing gRNA, a miRNA, or an antiMiR.

As used herein, the term "EPR-enhancing gRNA" refers to a gRNA, which, in combination with a Cas9 molecule (e.g., an eiCas9 molecule), enhances (e.g., increases the frequency or efficiency of) error-prone repair (e.g., alt-NJEH and SSA). In some embodiments, the EPR-enhancing gRNA guides a Cas9-mediated reduction in the transcription of a gene encoding a non-error-prone DNA damage repair pathway protein. In some embodiments, the EPR-enhancing gRNA guides a Cas9-mediated cleavage event in a gene encoding a non-error-prone DNA damage repair pathway protein (e.g., a protein involved in HDR, such as HR, alt-HR, and/or SSA).

As used herein, the term "gRNA molecule" or "gRNA" refers to a guide RNA which is capable of targeting a Cas9 molecule to a target nucleic acid. In one embodiment, the term "gRNA molecule" refers to a gRNA. In another embodiment, the term "gRNA molecule" refers to a nucleic acid encoding a gRNA.

"HDR", or homology-directed repair, as used herein, refers to the process of repairing DNA damage using a homologous nucleic acid (e.g., a sister chromatid or an exogenous nucleic acid, e.g., a template nucleic acid). HDR typically occurs when there has been significant resection at a double strand break, forming at least one single stranded portion of DNA. HDR is a category that includes, for example, single-strand annealing (SSA), homologous recombination (HR), and a third, not yet fully characterized alternative homologous recombination (alt-HR) DNA repair pathway (see FIG. 1). In some embodiments, the term HDR does not encompass canonical NHEJ (C-NHEJ). In some embodiments, the term HDR does not encompass alternative non-homologous end joining (Alt-NHEJ) (e.g., blunt end-joining (blunt EJ), (micro homology mediated end joining (MMEJ), and synthesis dependent microhomology-mediated end joining (SD-MMEJ)).

As used herein, the term "HDR-enhancer molecule" or "HDR enhancer" refers to an agent that enhances (e.g., increases the frequency or efficiency of) HDR (e.g., SSA, HR, or alt-HR). In some embodiments, and HDR-enhancer may act on one HDR pathway component to enhance (e.g., increase the frequency or efficiency of) the other HDR pathways. For example, an HDR-enhancer may down-regulate HR in order to enhance SSA and/or alt-HR. In another embodiment, an HDR-enhancer may down-regulate SSA to enhance HR and/or alt-HR. In yet another embodiment, an HDR-enhancer may downregulate alt-HR to enhance HR and/or SSA. In some embodiments, the HDR-enhancer acts to down-regulate a target in a DNA damage repair pathway, e.g., anti-HR, SSA, SSBR, alt-NHEJ, canonical NHEJ, or SDMMEJ. The HDR-enhancer may act on, e.g., inhibit, a protein or nucleic acid (e.g., a miRNA) that stimulates a non-HDR form of DNA repair. The HDR-enhancer molecule may be, e.g., a small molecule, a macromolecule, a protein, an antibody, e.g., an intrabody, a peptide, a nucleic acid, a siRNA, a HDR-enhancing gRNA, a miRNA, or an antiMiR. Alternatively, an HDR-enhancer molecule may be a nucleic acid encoding a protein, a protein, e.g., a dominant negative protein, an antibody, an HDR-enhancing gRNA, a miRNA, or an antiMiR.

As used herein, the term "HDR-enhancing gRNA molecule" or "HDR-enhancing gRNA" refers to a gRNA, which, in combination with a Cas9 molecule (e.g., an eiCas9 molecule or an eaCas9 molecule), enhances (e.g., increases the frequency or efficiency of) HDR (e.g., SSA, HR, or alt-HR) as compared to what would occur in the absence of the HDR-enhancing gRNA molecule. In some embodiments, the HDR-enhancing gRNA molecule guides a Cas9-mediated reduction in the transcription of a gene encoding a DNA damage repair pathway protein. In some embodiments, the HDR-enhancing gRNA molecule guides a Cas9-mediated cleavage event in a gene encoding a DNA damage repair pathway protein. In some embodiments, the DNA damage repair pathway protein is a protein involved in a non-HDR form of DNA repair. In one embodiment, the HDR-enhancing gRNA molecule is a gRNA. In another embodiment, the HDR-enhancing gRNA molecule is a nucleic acid encoding a gRNA.

The terms "homology" or "identity," as used interchangeably herein, refer to sequence identity between two amino acid sequences or two nucleic acid sequences, with identity being a more strict comparison. The phrases "percent identity or homology" and "% identity or homology" refer to the percentage of sequence identity found in a comparison of two or more amino acid sequences or nucleic acid sequences. Two or more sequences can be anywhere from 0-100% identical, or any value there between. Identity can be determined by comparing a position in each sequence that can be aligned for purposes of comparison to a reference sequence. When a position in the compared sequence is occupied by the same nucleotide base or amino acid, then the molecules are identical at that position. A degree of identity of amino acid sequences is a function of the number of identical amino acids at positions shared by the amino acid sequences. A degree of identity between nucleic acid sequences is a function of the number of identical or matching nucleotides at positions shared by the nucleic acid sequences. A degree of homology of amino acid sequences is a function of the number of amino acids at positions shared by the polypeptide sequences.

Calculations of homology or sequence identity between two sequences (the terms are used interchangeably herein) are performed as follows. The sequences are aligned for optimal comparison purposes (e.g., gaps can be introduced in one or both of a first and a second amino acid or nucleic acid sequence for optimal alignment and non-homologous sequences can be disregarded for comparison purposes). The optimal alignment is determined as the best score using the GAP program in the GCG software package with a Blossum 62 scoring matrix with a gap penalty of 12, a gap extend penalty of 4, and a frame shift gap penalty of 5. The amino acid residues or nucleotides at corresponding amino acid positions or nucleotide positions are then compared. When a position in the first sequence is occupied by the same amino acid residue or nucleotide as the corresponding position in the second sequence, then the molecules are identical at that position. The percent identity between the two sequences is a function of the number of identical positions shared by the sequences.

The term, "HR" refers to a type of HDR DNA-repair which typically acts occurs when there has been significant resection at the double strand break, forming at least one single stranded portion of DNA. In a normal cell, HR" or "Homologous recombination" typically involves a series of steps such as recognition of the break, stabilization of the break, resection, stabilization of single stranded DNA, formation of a DNA crossover intermediate, resolution of the crossover intermediate, and ligation. The process requires RAD51 and BRCA2, and the homologous nucleic acid is typically double-stranded.

The term "inhibitor" as used herein refers to a molecule that binds a specified biological target, thereby inhibiting the function of that biological target. An inhibitor may be, e.g., a small molecule or a siRNA. The biological target may be, e.g., a protein or an RNA (such as an mRNA or a miRNA). In embodiments, the inhibitor is specific for the biological target, e.g., lacks substantial activity against one or more control biological targets. In embodiments, the inhibitor has substantial activity towards only one biological target, or less than 3 biological targets, or less than 5 biological targets. In embodiments, the inhibitor promotes degradation of the biological target.

"Landmark" or "landmark position", as used herein, refers to a nucleotide in a target nucleic acid.

"Large molecule", as used herein, refers to a molecule having a molecular weight of at least 2, 3, 5, 10, 20, 30, 40, 50, 60, 70, 80, 90, or 100 kDa. Large molecules include proteins, polypeptides, nucleic acids, biologics, and carbohydrates.

"Linker", as that term is used herein, refers to a sequence comprising at least one amino acid. Typically it is disposed between sequences or domains of a Cas9. In an embodiment, the linker is disposed between the amino acid residues that flank a deletion. In an embodiment, the linker is disposed between the amino acid residues of a Cas9 core domain and an altered PI domain. By way of example, in a sequence $_{CT}1$-$_{CT}2$-$_{CT}3$-$_{CT}7$-$_{CT}8$-$_{CT}9$, wherein $_{CT}4$-$_{CT}5$-$_{CT}6$ is deleted, the linker is located immediately C-terminal to the amino acid residue $_{CT}3$ and immediately N-terminal to the amino acid residue $_{CT}7$. Preferably, the linker is selected such that the Cas9 molecule exhibits a tertiary structure or folded conformation similar to that of the corresponding naturally occurring Cas9 molecule, such that some Cas9 activity is retained. Suitable linkers are described herein. In an embodiment, the linker comprises a combination of Gly and Ser residues, e.g., $(GS)_x$ (SEQ ID NO: 341) or $(GGS)_x$ (SEQ ID NO: 339), where x is 1, 2, 3, 4, 5, 6, 7, 8, 9 or 10. In an embodiment, the linker comprises a linker comprising the amino acid sequence (SGSETPGTSESATPES)x, where x is 1, 2, 3, or 4 (SEQ ID NO: 344), referred to herein as XTEN linker or XTEN. Alternative linkers include $(GSAGSAAGSGEF)_x$, wherein x is 1, 2, 3 or 4 (SEQ ID NO: 201) and $(SIVAQLSRPDPA)_x$, wherein x is 1, 2, 3 or 4 (SEQ ID NO: 202). Linkers also include a combination of linkers described herein or known in the art.

"Modulator", as used herein, refers to an entity, e.g., a compound, that can alter the activity (e.g., enzymatic activity, transcriptional activity, or translational activity), amount, distribution, or structure of a subject molecule or genetic sequence. In an embodiment, modulation comprises cleavage, e.g., breaking of a covalent or non-covalent bond, or the forming of a covalent or non-covalent bond, e.g., the attachment of a moiety, to the subject molecule. In an embodiment, a modulator alters the three dimensional, secondary, tertiary, or quaternary structure, of a subject molecule. A modulator can increase, decrease, initiate, or eliminate a subject activity.

"PI domain", as that term is used herein, refers to the region of a Cas9 molecule that interacts with the PAM sequence of a target nucleic acid.

"Prevent," "preventing" and "prevention," as used herein, means the prevention of a disease in a subject, e.g., a mammal, e.g., in a human, including (a) avoiding or precluding the disease; (2) affecting the predisposition toward the disease, e.g., preventing at least one symptom of the disease or to delay onset of at least one symptom of the disease.

"REC deletion", as that term is used herein, refers to a REC2 deletion, a $REC1_{CT}$ deletion, or a $REC1_{SUB}$ deletion.

"n" as used herein in the context of proteins or Cas9 molecules described herein, refers to the number of amino acid residues that are deleted in a REC2, $REC1_{CT}$, or $REC1_{SUB}$ deletion, unless otherwise specified.

Unless indicate otherwise, "NHEJ" as used herein encompasses canonical NHEJ and alt-NHEJ.

"Polypeptide", as used herein, refers to a polymer of amino acids.

"REC2 deletion", as that term is used herein, refers to a deletion of at least 10% of the amino acid residues of the REC2 domain.

"REC2 domain", as that term is used herein, refers to a region, in the N terminal half of a naturally occurring Cas9 molecule that is not needed for cleavage or gRNA-mediated targeting. Its length and boundaries differ between Cas9 molecules from various species. In the case of S. aureus, the REC2 domain is about 41 amino acid residues in length and corresponds, approximately, to residues 126 to 166, of S. aureus Cas9. In the case of S. pyogenes, the REC2 domain is about 139 amino acid residues in length and corresponds, approximately, to residues 176 to 314 of S. pyogenes Cas9. In the case of C. jejuni, the REC2 domain is about 45 amino acid residues in length and corresponds, approximately, to residues 137 to 181 of C. jejuni Cas9. These, and the approximate sizes and boundaries of REC2 domains from other species are provided in Table III.1.

"$REC1_{CT}$ deletion", as that term is used herein, refers to a deletion of at least 10% of the amino acid residues of the $REC1_{CT}$ domain.

"$REC1_{CT}$ domain", as that term is used herein, refers to a region, C terminal of the REC1 domain, of a naturally occurring Cas9 polypeptide that is not needed for cleavage or gRNA-mediated targeting. Its length and boundaries differ between Cas9 proteins from various species. In the case of S. aureus, the $REC1_{CT}$ domain is about 146 amino acid residues in length and corresponds, approximately, to residues 288 to 166, of S. aureus Cas9. In the case of S. pyogenes, the $REC1_{CT}$ domain is about 219 amino acid residues in length and corresponds, approximately, to residues 500 to 718 of S. pyogenes Cas9. In the case of C. jejuni, the $REC1_{CT}$ domain is about 134 amino acid residues in length and corresponds, approximately, to residues 305 to 438 of C. jejuni Cas9. These, and the approximate sizes and boundaries of $REC1_{CT}$ domains from other species are provided in Table III.1.

"$REC1_{SUB}$ deletion", as that term is used herein, refers to a deletion of at least 10% of the amino acid residues of the $REC1_{SUB}$ domain.

"$REC1_{SUB}$ domain", as that term is used herein, refers to a region, located within the $REC1_{CT}$ domain, of a naturally occurring Cas9 polypeptide that is not needed for cleavage or gRNA-mediated targeting. Its length and boundaries differ between Cas9 proteins from various species. In the case of S. aureus, the $REC1_{Sub}$ domain is about 57 amino acid residues in length and corresponds, approximately, to residues 296 to 352, of S. aureus Cas9. In the case of S. pyogenes, the $REC1_{Sub}$ domain is about 82 amino acid residues in length and corresponds, approximately, to residues 511 to 592 of S. pyogenes Cas9. In the case of C. jejuni, the $REC1_{Sub}$ domain is about 45 amino acid residues in length and corresponds, approximately, to residues 316 to 360 of C. jejuni Cas9. These, and the approximate sizes and boundaries of $REC1_{Sub}$ domains from other species are provided in Table III.1.

"Reference molecule", e.g., a reference Cas9 molecule or reference gRNA, as used herein, refers to a molecule to which a subject molecule, e.g., a subject Cas9 molecule of subject gRNA molecule, e.g., a modified or candidate Cas9 molecule is compared. For example, a Cas9 molecule can be characterized as having no more than 10% of the nuclease activity of a reference Cas9 molecule. Examples of reference Cas9 molecules include naturally occurring unmodified Cas9 molecules, e.g., a naturally occurring Cas9 molecule such as a Cas9 molecule of S. pyogenes, or S. thermophilus. In an embodiment, the reference Cas9 molecule is the naturally occurring Cas9 molecule having the closest sequence identity or homology with the Cas9 molecule to which it is being compared. In an embodiment, the reference Cas9 molecule is a sequence, e.g., a naturally occurring or known sequence, which is the parental form on which a change, e.g., a mutation has been made.

"Replacement", or "replaced", as used herein with reference to a modification of a molecule does not require a process limitation but merely indicates that the replacement entity is present.

"Resection", as used herein, refers to exonuclease-mediated digestion of one strand of a double-stranded DNA molecule, which results in a single-stranded overhang. Resection may occur, e.g., on one or both sides of a double-stranded break. Resection can be measured by, for instance, extracting genomic DNA, digesting it with an enzyme that selectively degrades dsDNA, and performing quantitative PCR using primers spanning the DSB site, e.g., as described in Section IV.

"Small molecule", as used herein, refers to a compound having a molecular weight less than about 2 kDa, e.g., less than about 2 kDa, less than about 1.5 kDa, less than about 1 kDa, or less than about 0.75 kDa.

"Subject", as used herein, may mean either a human or non-human animal. The term includes, but is not limited to, mammals (e.g., humans, other primates, pigs, rodents (e.g., mice and rats or hamsters), rabbits, guinea pigs, cows, horses, cats, dogs, sheep, and goats). In an embodiment, the subject is a human. In other embodiments, the subject is poultry. In another embodiment, the subject is a fish.

"SSA" or "Single Strand Anealing", as used herein, refers to the process where RAD52 as opposed to RAD51 in the HR pathways, binds to the single stranded portion of DNA and promotes annealing of the two single stranded DNA segments at repetitive regions. Once RAD52 binds XFP/ERCC1 removes DNA flaps to make the DNA more suitable for ligation.

A "synthetic Cas9 molecule", or "Syn-Cas9 molecule", as that term is used herein, refers to a Cas9 molecule that comprises a Cas9 core domain from one bacterial species and a functional altered PI domain, i.e., a PI domain other than that naturally associated with the Cas9 core domain, e.g., from a different bacterial species. Syn-Cas9 polypeptides are also provided.

As used herein, the term "target nucleic acid" refers to a nucleic acid which is being targeted for alteration by a Cas9 system described herein. In one embodiment, a target nucleic acid comprise one gene. In another embodiment, a target nucleic acid may comprise one or more genes, e.g., two genes, three genes, four genes, or five genes.

"Target position" as used herein, refers to a site on a target nucleic acid (e.g., the chromosome) that is modified by a Cas9 molecule-dependent process. For example, the target position can be modified by a Cas9 molecule-mediated cleavage of the target nucleic acid and template nucleic acid directed modification, e.g., correction, of the target position. In an embodiment, a target position can be a site between two nucleotides, e.g., adjacent nucleotides, on the target nucleic acid into which one or more nucleotides is added. The target position may comprise one or more nucleotides that are altered, e.g., corrected, by a template nucleic acid. In an embodiment, the target position is within a "target sequence" (e.g., the sequence to which the gRNA binds). In an embodiment, a target position is upstream or downstream of a target sequence (e.g., the sequence to which the gRNA binds).

The "targeting domain" of the gRNA is complementary to the "target domain" on the target nucleic acid.

A "target sequence" is the sequence of a target domain.

A "template nucleic acid" as that term is used herein, refers to a nucleic acid sequence which can be used in conjunction with a Cas9 molecule and a gRNA molecule to alter the structure of a target position. In an embodiment, the target nucleic acid is modified to have the some or all of the sequence of the template nucleic acid, typically at or near cleavage site(s). In an embodiment, the template nucleic acid is single stranded. In an alternate embodiment, the template nucleic acid is double stranded. In an embodiment, the template nucleic acid is DNA, e.g., double stranded DNA. In an alternate embodiment, the template nucleic acid is single stranded DNA. In an embodiment, the template nucleic acid is RNA, e.g., double stranded RNA or single stranded RNA. In an embodiment, the template nucleic acid is encoded on the same vector backbone, e.g., AAV genome, plasmid DNA, as the Cas9 and gRNA. In an embodiment, the template nucleic acid is excised from a vector backbone in vivo, e.g., it is flanked by gRNA recognition sequences. In one embodiment, the template DNA is in an ILDV. In another embodiment, the template DNA is an endogenous nucleic acid sequence. In one embodiment, the template nucleic acid is a single stranded oligonucleotide corresponding to a plus strand of a nucleic acid sequence. In another embodiment, the template nucleic acid is a single stranded oligonucleotide corresponding to a minus strand of a nucleic acid sequence.

As used herein, the term "transcription activator" refers to a polypeptide or a nucleic acid encoding a polypeptide that increases the transcription of a gene or a set of genes. A transcription activator may be a DNA-binding protein that binds to an enhancer or a promoter-proximal element. In one embodiment, a transcription activator is fused to, or linked to, a Cas9 molecule of the invention in order to temporarily increase transcription of a gene or genes. In one embodiment, the Cas9 molecule is an eaCas9 molecule.

As used herein, the term "transcription repressor" refers to a polypeptide or a nucleic acid encoding a polypeptide that decreases or inhibits the transcription of a gene or a set of genes. A transcription repressor may be a DNA-binding protein that binds to an enhancer or a promoter-proximal element. In one embodiment, a transcription repressor is fused to, or linked to, a Cas9 molecule of the invention in order to temporarily decrease, or temporarily inhibit transcription of a gene or genes. In one embodiment, the Cas9 molecule is an eaCas9 molecule.

"Treat", "treating" and "treatment", as used herein, mean the treatment of a disease in a mammal, e.g., in a human, including (a) inhibiting the disease, i.e., arresting or preventing its development; (b) relieving the disease, i.e., causing regression of the disease state; and (c) curing the disease.

An "up-regulator", as used herein, refers to an agent that directly increases the activity of a specified biological pathway. Directly increasing the activity of the pathway refers to (i) the up-regulator binding to a component of that pathway (e.g., a protein that acts in the pathway or an mRNA encoding that protein) and increasing the level or activity of that component, e.g., by increasing the concentration or specific activity of that component, or (ii) the up-regulator is an added amount of a component that is ordinarily present in the pathway at a given level, e.g., an overexpressed protein. An up-regulator may, e.g., speed up one of the steps of that pathway or increase the level or activity of a component in that pathway. An up-regulator may be, e.g., a protein in the pathway, e.g., one may overexpress a protein that is ordinarily in the pathway to increase the overall activity of the pathway. The pathway may be, e.g., a DNA damage repair pathway, for example, HDR. In an embodiment, the increased level or activity is compared to what would be seen in the absence of the up-regulator.

"Wild type", as used herein, refers to a gene or polypeptide which has the characteristics, e.g., the nucleotide or amino acid sequence, of a gene or polypeptide from a naturally-occurring source. The term "wild type" typically includes the most frequent observation of a particular gene or polypeptide in a population of organisms found in nature.

"X" as used herein in the context of an amino acid sequence of a linker sequence, refers to any number of repeating units unless otherwise specified.

"X" as used herein in the context of a Cas9 molecule or core domain, e.g., "species X Cas9" designates the species from which the Cas9 molecule or core domain is derived from.

I. gRNA Molecules

A gRNA molecule, as that term is used herein, refers to a nucleic acid that promotes the specific targeting or homing of a gRNA molecule/Cas9 molecule complex to a target nucleic acid. Typically, the nucleic acid will incorporate the functions or structure of both crRNA and tracrRNA, e.g., the functions of processed or mature crRNA and of processed or mature tracrRNA. gRNA molecules can be unimolecular (having a single nucleic acid molecule, e.g., which incorporates both crRNA function or structure and the tracrRNA function or structure), sometimes referred to herein as "chimeric" gRNAs, or modular (comprising more than one, and typically two, separate nucleic acid molecules, e.g., where one incorporates the crRNA function or structure and the other incorporates the tracrRNA function or structure). A gRNA molecule comprises a number of domains. The gRNA molecule domains are described in more detail below. Additional details on gRNAs are provided in Section I entitled "gRNA molecules" of PCT Application WO 2015/048577, the entire contents of which are expressly incorporated herein by reference.

In an embodiment, a unimolecular, or chimeric, gRNA comprises, preferably from 5' to 3': a targeting domain (which is complementary to a target nucleic acid, and which is sometimes referred to as a spacer); a first complementarity domain; a linking domain; a second complementarity domain (which is complementary to the first complementarity domain); a proximal domain; and optionally, a tail domain. In an embodiment, the targeting domain, and first complementarity domain correspond functionally or structurally to elements of a crRNA, e.g., a mature or processed crRNA. In an embodiment, the second complementarity domain, proximal domain, and tail domain correspond functionally or structurally to elements of a tracrRNA, e.g., a processed or mature tracrRNA.

In an embodiment, a modular gRNA comprises: a first strand (which corresponds to a crRNA) comprising, preferably from 5' to 3'; a targeting domain (which is complementary to a target nucleic acid); and a first complementarity domain; and a second strand (which corresponds to a tracrRNA), comprising, preferably from 5' to 3': optionally, a 5' extension domain; a second complementarity domain; a proximal domain; and optionally, a tail domain.

The domains are discussed briefly below.

Targeting Domain

The targeting domain (which can also be referred to as a "spacer") comprises a nucleotide sequence that is complementary, e.g., at least 80, 81, 82, 83, 84, 85, 86, 87, 88, 89, 90, 91, 92, 93, 94, 95, 96, 97, 98, or 99% complementary, e.g., fully complementary, to the target sequence on the target nucleic acid. The targeting domain is part of an RNA molecule and will therefore comprise the base uracil (U), while any DNA encoding the gRNA molecule will comprise the base thymine (T). While not wishing to be bound by theory, in an embodiment, it is believed that the complementarity of the targeting domain with the target sequence contributes to specificity of the interaction of the gRNA molecule/Cas9 molecule complex with a target nucleic acid. It is understood that in a targeting domain and target sequence pair, the uracil bases in the targeting domain will pair with the adenine bases in the target sequence. In an embodiment, the targeting domain itself comprises in the 5' to 3' direction, an optional secondary domain, and a core domain. In an embodiment, the core domain is fully complementary with the target sequence. In an embodiment, the targeting domain is 5 to 50 nucleotides in length, e.g., 10 to 30, e.g., 16, 17, 18, 19, 20, 21, 22, 23, 24, 25 or 26, nucleotides in length. The strand of the target nucleic acid with which the targeting domain is complementary is referred to herein as the complementary strand. Some or all of the nucleotides of the targeting domain can have a modification, e.g., a modification found in Section X herein.

In an embodiment, the targeting domain is 16 nucleotides in length. In an embodiment, the targeting domain is 17 nucleotides in length. In an embodiment, the targeting domain is 18 nucleotides in length. In an embodiment, the targeting domain is 19 nucleotides in length. In an embodiment, the targeting domain is 20 nucleotides in length. In an embodiment, the targeting domain is 21 nucleotides in length. In an embodiment, the targeting domain is 22 nucleotides in length. In an embodiment, the targeting domain is 23 nucleotides in length. In an embodiment, the targeting domain is 24 nucleotides in length. In an embodiment, the targeting domain is 25 nucleotides in length. In an embodiment, the targeting domain is 26 nucleotides in length. In an embodiment, the targeting domain comprises 16 nucleotides. In an embodiment, the targeting domain comprises 17 nucleotides. In an embodiment, the targeting domain comprises 18 nucleotides. In an embodiment, the targeting domain comprises 19 nucleotides. In an embodiment, the targeting domain comprises 20 nucleotides. In an embodiment, the targeting domain comprises 21 nucleotides. In an embodiment, the targeting domain comprises 22 nucleotides. In an embodiment, the targeting domain comprises 23 nucleotides. In an embodiment, the targeting domain comprises 24 nucleotides. In an embodiment, the targeting domain comprises 25 nucleotides. In an embodiment, the targeting domain comprises 26 nucleotides.

Targeting domains are discussed in more detail below.

First Complementarity Domain

The first complementarity domain is complementary with the second complementarity domain, and in an embodiment, has sufficient complementarity to the second complementarity domain to form a duplexed region under at least some physiological conditions. In an embodiment, the first complementarity domain is 5 to 30 nucleotides in length. In an embodiment, the first complementarity domain is 5 to 25 nucleotides in length. In an embodiment, the first complementary domain is 7 to 25 nucleotides in length. In an embodiment, the first complementary domain is 7 to 22 nucleotides in length. In an embodiment, the first complementary domain is 7 to 18 nucleotides in length. In an embodiment, the first complementary domain is 7 to 15 nucleotides in length. In an embodiment, the first complementary domain is 5, 6, 7, 8, 9, 10, 11, 12, 13, 14, 15, 16, 17, 18, 19, 20, 21, 22, 23, 24, or 25 nucleotides in length.

In an embodiment, the first complementarity domain comprises 3 subdomains, which, in the 5' to 3' direction are: a 5' subdomain, a central subdomain, and a 3' subdomain. In an embodiment, the 5' subdomain is 4 to 9, e.g., 4, 5, 6, 7, 8 or 9 nucleotides in length. In an embodiment, the central subdomain is 1, 2, or 3, e.g., 1, nucleotide in length. In an embodiment, the 3' subdomain is 3 to 25, e.g., 4 to 22, 4 to 18, or 4 to 10, or 3, 4, 5, 6, 7, 8, 9, 10, 11, 12, 13, 14, 15, 16, 17, 18, 19, 20, 21, 22, 23, 24, or 25 nucleotides in length.

The first complementarity domain can share homology with, or be derived from, a naturally occurring first complementarity domain. In an embodiment, it has at least 50% homology with a first complementarity domain disclosed herein, e.g., an *S. pyogenes, S. aureus* or *S. thermophilus*, first complementarity domain.

Some or all of the nucleotides of the domain can have a modification, e.g., a modification found in Section X herein.

First complementarity domains are discussed in more detail below.

Linking Domain

A linking domain serves to link the first complementarity domain with the second complementarity domain of a unimolecular gRNA. The linking domain can link the first and second complementarity domains covalently or non-covalently. In an embodiment, the linkage is covalent. In an embodiment, the linking domain covalently couples the first and second complementarity domains. In an embodiment, the linking domain is, or comprises, a covalent bond interposed between the first complementarity domain and the second complementarity domain. Typically the linking domain comprises one or more, e.g., 2, 3, 4, 5, 6, 7, 8, 9, or 10 nucleotides.

In modular gRNA molecules the two molecules are associated by virtue of the hybridization of the complementarity domains.

A wide variety of linking domains are suitable for use in unimolecular gRNA molecules. Linking domains can consist of a covalent bond, or be as short as one or a few nucleotides, e.g., 1, 2, 3, 4, or 5 nucleotides in length. In an embodiment, a linking domain is 2, 3, 4, 5, 6, 7, 8, 9, 10, 15, 20, or 25 or more nucleotides in length. In an embodiment, a linking domain is 2 to 50, 2 to 40, 2 to 30, 2 to 20, 2 to 10, or 2 to 5 nucleotides in length. In an embodiment, a linking domain shares homology with, or is derived from, a naturally occurring sequence, e.g., the sequence of a tracrRNA that is 5' to the second complementarity domain. In an embodiment, the linking domain has at least 50% homology with a linking domain disclosed herein.

Some or all of the nucleotides of the domain can have a modification, e.g., a modification found in Section X herein.

Linking domains are discussed in more detail below.

5' Extension Domain

In an embodiment, a modular gRNA can comprise additional sequence, 5' to the second complementarity domain, referred to herein as the 5' extension domain. In an embodiment, the 5' extension domain is, 2 to 10, 2 to 9, 2 to 8, 2 to 7, 2 to 6, 2 to 5, or 2 to 4, nucleotides in length. In an embodiment, the 5' extension domain is 2, 3, 4, 5, 6, 7, 8, 9, or 10 or more nucleotides in length.

Second Complementarity Domain

The second complementarity domain is complementary with the first complementarity domain, and in an embodiment, has sufficient complementarity to the second complementarity domain to form a duplexed region under at least some physiological conditions. In an embodiment, the second complementarity domain can include sequence that lacks complementarity with the first complementarity domain, e.g., sequence that loops out from the duplexed region.

In an embodiment, the second complementarity domain is 5 to 27 nucleotides in length. In an embodiment, it is longer than the first complementarity region. In an embodiment the second complementary domain is 7 to 27 nucleotides in length. In an embodiment, the second complementary domain is 7 to 25 nucleotides in length. In an embodiment, the second complementary domain is 7 to 20 nucleotides in length. In an embodiment, the second complementary domain is 7 to 17 nucleotides in length. In an embodiment, the complementary domain is 5, 6, 7, 8, 9, 10, 11, 12, 13, 14, 15, 16, 17, 18, 19, 20, 21, 22, 23, 24, 25 or 26 nucleotides in length.

In an embodiment, the second complementary domain comprises 3 subdomains, which, in the 5' to 3' direction are: a 5' subdomain, a central subdomain, and a 3' subdomain. In an embodiment, the 5' subdomain is 3 to 25, e.g., 4 to 22, 4 to 18, or 4 to 10, or 3, 4, 5, 6, 7, 8, 9, 10, 11, 12, 13, 14, 15, 16, 17, 18, 19, 20, 21, 22, 23, 24, or 25 nucleotides in length. In an embodiment, the central subdomain is 1, 2, 3, 4 or 5, e.g., 3, nucleotides in length. In an embodiment, the 3' subdomain is 4 to 9, e.g., 4, 5, 6, 7, 8 or 9 nucleotides in length.

In an embodiment, the 5' subdomain and the 3' subdomain of the first complementarity domain, are respectively, complementary, e.g., fully complementary, with the 3' subdomain and the 5' subdomain of the second complementarity domain.

The second complementarity domain can share homology with or be derived from a naturally occurring second complementarity domain. In an embodiment, it has at least 50% homology with a second complementarity domain disclosed herein, e.g., an *S. pyogenes, S. aureus* or *S. thermophilus*, first complementarity domain.

Some or all of the nucleotides of the domain can have a modification, e.g., a modification found in Section X herein.

Proximal Domain

In an embodiment, the proximal domain is 5 to 20 nucleotides in length. In an embodiment, the proximal domain can share homology with or be derived from a naturally occurring proximal domain. In an embodiment, it has at least 50% homology with a proximal domain disclosed herein, e.g., an *S. pyogenes, S. aureus* or *S. thermophilus*, proximal domain.

Some or all of the nucleotides of the domain can have a modification, e.g., a modification found in Section X herein.

Tail Domain

A broad spectrum of tail domains are suitable for use in gRNA molecules. In an embodiment, the tail domain is 0 (absent), 1, 2, 3, 4, 5, 6, 7, 8, 9, or 10 nucleotides in length. In embodiment, the tail domain nucleotides are from or share homology with sequence from the 5' end of a naturally occurring tail domain. In an embodiment, the tail domain includes sequences that are complementary to each other and which, under at least some physiological conditions, form a duplexed region.

In an embodiment, the tail domain is absent or is 1 to 50 nucleotides in length. In an embodiment, the tail domain can share homology with or be derived from a naturally occurring proximal tail domain. In an embodiment, it has at least 50% homology with a tail domain disclosed herein, e.g., an *S. pyogenes, S. aureus* or *S. thermophilus*, tail domain.

In an embodiment, the tail domain includes nucleotides at the 3' end that are related to the method of in vitro or in vivo transcription. When a T7 promoter is used for in vitro transcription of the gRNA, these nucleotides may be any nucleotides present before the 3' end of the DNA template. When a U6 promoter is used for in vivo transcription, these nucleotides may be the sequence UUUUUU. When alternate pol-III promoters are used, these nucleotides may be various numbers or uracil bases or may include alternate bases.

In an embodiment the 3' end of the tail domain is modified to render the gRNA non-toxic to cells or whole organisms e.g., humans.

The domains of gRNA molecules are described in more detail below.

Targeting Domain

The "targeting domain" of the gRNA is complementary to the "target domain" on the target nucleic acid. The strand of the target nucleic acid comprising the nucleotide sequence complementary to the core domain of the gRNA is referred to herein as the "complementary strand" of the target nucleic acid. Guidance on the selection of targeting domains can be found, e.g., in Fu Y et al. (2014) NAT. BIOTECHNOL. 32: 279-84 (doi: 10.1038/nbt.2808) and Sternberg S H et al. (2014) NATURE 507: 62-7 (doi: 10.1038/nature13011).

In an embodiment, the targeting domain is 16, 17, 18, 19, 20, 21, 22, 23, 24, 25 or 26 nucleotides in length.

In an embodiment, the targeting domain is 16 nucleotides in length. In an embodiment, the targeting domain is 17 nucleotides in length. In an embodiment, the targeting domain is 18 nucleotides in length. In an embodiment, the targeting domain is 19 nucleotides in length. In an embodiment, the targeting domain is 20 nucleotides in length. In an embodiment, the targeting domain is 21 nucleotides in length. In an embodiment, the targeting domain is 22 nucleotides in length. In an embodiment, the targeting domain is 23 nucleotides in length. In an embodiment, the targeting domain is 24 nucleotides in length. In an embodiment, the targeting domain is 25 nucleotides in length. In an embodiment, the targeting domain is 26 nucleotides in length. In an embodiment, the targeting domain comprises 16 nucleotides. In an embodiment, the targeting domain comprises 17 nucleotides. In an embodiment, the targeting domain comprises 18 nucleotides. In an embodiment, the targeting domain comprises 19 nucleotides. In an embodiment, the targeting domain comprises 20 nucleotides. In an embodiment, the targeting domain comprises 21 nucleotides. In an embodiment, the targeting domain comprises 22 nucleotides. In an embodiment, the targeting domain comprises 23 nucleotides. In an embodiment, the targeting domain comprises 24 nucleotides. In an embodiment, the targeting domain comprises 25 nucleotides. In an embodiment, the targeting domain comprises 26 nucleotides.

In an embodiment, the targeting domain is 10+/−5, 20+/−5, 30+/−5, 40+/−5, 50+/−5, 60+/−5, 70+/−5, 80+/−5, 90+/−5, or 100+/−5 nucleotides, in length. In an embodiment, the targeting domain is 20+/−5 nucleotides in length. In an embodiment, the targeting domain is 20+/−10, 30+/−10, 40+/−10, 50+/−10, 60+/−10, 70+/−10, 80+/−10, 90+/−10, or 100+/−10 nucleotides, in length. In an embodiment, the targeting domain is 30+/−10 nucleotides in length. In an embodiment, the targeting domain is 10 to 100, 10 to 90, 10 to 80, 10 to 70, 10 to 60, 10 to 50, 10 to 40, 10 to 30, 10 to 20 or 10 to 15 nucleotides in length. In another embodiment, the targeting domain is 20 to 100, 20 to 90, 20 to 80, 20 to 70, 20 to 60, 20 to 50, 20 to 40, 20 to 30, or 20 to 25 nucleotides in length.

Typically the targeting domain has full complementarity with the target sequence. In an embodiment the targeting domain has or includes 1, 2, 3, 4, 5, 6, 7 or 8 nucleotides that are not complementary with the corresponding nucleotide of the targeting domain.

In an embodiment, the target domain includes 1, 2, 3, 4 or 5 nucleotides that are complementary with the corresponding nucleotide of the targeting domain within 5 nucleotides of its 5' end. In an embodiment, the target domain includes 1, 2, 3, 4 or 5 nucleotides that are complementary with the corresponding nucleotide of the targeting domain within 5 nucleotides of its 3' end.

In an embodiment, the target domain includes 1, 2, 3, or 4 nucleotides that are not complementary with the corresponding nucleotide of the targeting domain within 5 nucleotides of its 5' end. In an embodiment, the target domain includes 1, 2, 3, or 4 nucleotides that are not complementary with the corresponding nucleotide of the targeting domain within 5 nucleotides of its 3' end.

In an embodiment, the degree of complementarity, together with other properties of the gRNA, is sufficient to allow targeting of a Cas9 molecule to the target nucleic acid.

In an embodiment, the targeting domain comprises two consecutive nucleotides that are not complementary to the target domain ("non-complementary nucleotides"), e.g., two consecutive noncomplementary nucleotides that are within 5 nucleotides of the 5' end of the targeting domain, within 5 nucleotides of the 3' end of the targeting domain, or more than 5 nucleotides away from one or both ends of the targeting domain.

In an embodiment, no two consecutive nucleotides within 5 nucleotides of the 5' end of the targeting domain, within 5 nucleotides of the 3' end of the targeting domain, or within a region that is more than 5 nucleotides away from one or both ends of the targeting domain, are not complementary to the targeting domain.

In an embodiment, there are no non-complementary nucleotides within 5 nucleotides of the 5' end of the targeting domain, within 5 nucleotides of the 3' end of the targeting domain, or within a region that is more than 5 nucleotides away from one or both ends of the targeting domain.

In an embodiment, the targeting domain nucleotides do not comprise modifications, e.g., modifications of the type provided in Section X. However, in an embodiment, the targeting domain comprises one or more modifications, e.g., modifications that it render it less susceptible to degradation or more bio-compatible, e.g., less immunogenic. By way of example, the backbone of the targeting domain can be modified with a phosphorothioate, or other modification from Section X. In an embodiment, a nucleotide of the targeting domain can comprise a 2' modification (e.g., a modification at the 2' position on ribose), e.g., a 2-acetylation, e.g., a 2' methylation, or other modification(s) from Section X.

In an embodiment, the targeting domain includes 1, 2, 3, 4, 5, 6, 7 or 8 or more modifications. In an embodiment, the targeting domain includes 1, 2, 3, or 4 modifications within 5 nucleotides of its 5' end. In an embodiment, the targeting domain comprises as many as 1, 2, 3, or 4 modifications within 5 nucleotides of its 3' end.

In an embodiment, the targeting domain comprises modifications at two consecutive nucleotides, e.g., two consecutive nucleotides that are within 5 nucleotides of the 5' end of the targeting domain, within 5 nucleotides of the 3' end of the targeting domain, or more than 5 nucleotides away from one or both ends of the targeting domain.

In an embodiment, no two consecutive nucleotides are modified within 5 nucleotides of the 5' end of the targeting domain, within 5 nucleotides of the 3' end of the targeting domain, or within a region that is more than 5 nucleotides away from one or both ends of the targeting domain. In an embodiment, no nucleotide is modified within 5 nucleotides of the 5' end of the targeting domain, within 5 nucleotides of the 3' end of the targeting domain, or within a region that is more than 5 nucleotides away from one or both ends of the targeting domain.

Modifications in the targeting domain can be selected to not interfere with targeting efficacy, which can be evaluated by testing a candidate modification in the system described in Section IV. gRNAs having a candidate targeting domain having a selected length, sequence, degree of complementarity, or degree of modification, can be evaluated in a system in Section IV. The candidate targeting domain can be placed, either alone, or with one or more other candidate changes in a gRNA molecule/Cas9 molecule system known to be functional with a selected target and evaluated.

In an embodiment, all of the modified nucleotides are complementary to and capable of hybridizing to corresponding nucleotides present in the target domain. In another embodiment, 1, 2, 3, 4, 5, 6, 7 or 8 or more modified nucleotides are not complementary to or capable of hybridizing to corresponding nucleotides present in the target domain.

In an embodiment, the targeting domain comprises, preferably in the 5'→3' direction: a secondary domain and a core domain. These domains are discussed in more detail below.

Core Domain and Secondary Domain of the Targeting Domain

The "core domain" of the targeting domain is complementary to the "core domain target" on the target nucleic acid. In an embodiment, the core domain comprises about 8 to about 13 nucleotides from the 3' end of the targeting domain (e.g., the most 3' 8 to 13 nucleotides of the targeting domain).

In an embodiment, the core domain of the targeting domain and core domain target, are independently, 6+/−2, 7+/−2, 8+/−2, 9+/−2, 10+/−2, 11+/−2, 12+/−2, 13+/−2, 14+/−2, 15+/−2, or 16+−2, nucleotides in length.

In an embodiment, the core domain of the targeting domain and core domain target, are independently, 10+/−2 nucleotides in length.

In an embodiment, the core domain of the targeting domain and core domain target, are independently, 10+/−4 nucleotides in length.

In an embodiment, the core domain of the targeting domain and core domain target are independently 6, 7, 8, 9, 10, 11, 12, 13, 14, 15, 16, 17, or 18 nucleotides in length.

In an embodiment, the core domain of the targeting domain and core domain target are independently 3 to 20, 4 to 20, 5 to 20, 6 to 20, 7 to 20, 8 to 20, 9 to 20 10 to 20 or 15 to 20 nucleotides in length.

In an embodiment, the core domain of the targeting domain and core domain target are independently 3 to 15, e.g., 6 to 15, 7 to 14, 7 to 13, 6 to 12, 7 to 12, 7 to 11, 7 to 10, 8 to 14, 8 to 13, 8 to 12, 8 to 11, 8 to 10 or 8 to 9 nucleotides in length.

The core domain of the targeting domain is complementary with the core domain target. Typically the core domain has exact complementarity with the core domain target. In an embodiment, the core domain of the targeting domain can have 1, 2, 3, 4 or 5 nucleotides that are not complementary with the corresponding nucleotide of the core domain target. In an embodiment, the degree of complementarity, together with other properties of the gRNA molecule, is sufficient to allow targeting of a Cas9 molecule to the target nucleic acid.

The "secondary domain" of the targeting domain of the gRNA is complementary to the "secondary domain target" of the target nucleic acid.

In an embodiment, the secondary domain is positioned 5' to the core domain.

In an embodiment, the secondary domain is absent or optional.

In an embodiment, if the targeting domain is 26 nucleotides in length and the core domain (counted from the 3' end of the targeting domain) is 8 to 13 nucleotides in length, the secondary domain is 13 to 18 nucleotides in length.

In an embodiment, if the targeting domain is 25 nucleotides in length and the core domain (counted from the 3' end of the targeting domain) is 8 to 13 nucleotides in length, the secondary domain is 12 to 17 nucleotides in length.

In an embodiment, if the targeting domain is 24 nucleotides in length and the core domain (counted from the 3' end of the targeting domain) is 8 to 13 nucleotides in length, the secondary domain is 11 to 16 nucleotides in length.

In an embodiment, if the targeting domain is 23 nucleotides in length and the core domain (counted from the 3' end of the targeting domain) is 8 to 13 nucleotides in length, the secondary domain is 10 to 15 nucleotides in length.

In an embodiment, if the targeting domain is 22 nucleotides in length and the core domain (counted from the 3' end of the targeting domain) is 8 to 13 nucleotides in length, the secondary domain is 9 to 14 nucleotides in length.

In an embodiment, if the targeting domain is 21 nucleotides in length and the core domain (counted from the 3' end of the targeting domain) is 8 to 13 nucleotides in length, the secondary domain is 8 to 13 nucleotides in length.

In an embodiment, if the targeting domain is 20 nucleotides in length and the core domain (counted from the 3' end of the targeting domain) is 8 to 13 nucleotides in length, the secondary domain is 7 to 12 nucleotides in length.

In an embodiment, if the targeting domain is 19 nucleotides in length and the core domain (counted from the 3' end of the targeting domain) is 8 to 13 nucleotides in length, the secondary domain is 6 to 11 nucleotides in length.

In an embodiment, if the targeting domain is 18 nucleotides in length and the core domain (counted from the 3' end of the targeting domain) is 8 to 13 nucleotides in length, the secondary domain is 5 to 10 nucleotides in length.

In an embodiment, if the targeting domain is 17 nucleotides in length and the core domain (counted from the 3' end of the targeting domain) is 8 to 13 nucleotides in length, the secondary domain is 4 to 9 nucleotides in length.

In an embodiment, if the targeting domain is 16 nucleotides in length and the core domain (counted from the 3' end of the targeting domain) is 8 to 13 nucleotides in length, the secondary domain is 3 to 8 nucleotides in length.

In an embodiment, the secondary domain is 0, 1, 2, 3, 4, 5, 6, 7, 8, 9, 10, 11, 12, 13, 14, 15, 16, 17, or 18 nucleotides in length.

The secondary domain of the targeting domain is complementary with the secondary domain target. Typically, the secondary domain of the targeting domain has exact complementarity with the secondary domain target. In an embodiment the secondary domain of the targeting domain can have 1, 2, 3, 4 or 5 nucleotides that are not complementary with the corresponding nucleotide of the secondary domain target. In an embodiment, the degree of complementarity, together with other properties of the gRNA, is sufficient to allow targeting of a Cas9 molecule to the target nucleic acid.

In an embodiment, the core domain nucleotides do not comprise modifications, e.g., modifications of the type provided in Section X. However, in an embodiment, the core domain comprises one or more modifications, e.g., modifications that it render it less susceptible to degradation or more bio-compatible, e.g., less immunogenic. By way of example, the backbone of the core domain can be modified with a phosphorothioate, or other modification(s) from Section X. In an embodiment a nucleotide of the core domain can comprise a 2' modification (e.g., a modification at the 2' position on ribose), e.g., a 2-acetylation, e.g., a 2' methylation, or other modification(s) from Section X. Typically, a core domain will contain no more than 1, 2, or 3 modifications.

Modifications in the core domain can be selected to not interfere with targeting efficacy, which can be evaluated by testing a candidate modification in the system described in Section IV. gRNAs having a candidate core domain having a selected length, sequence, degree of complementarity, or degree of modification, can be evaluated in the system described at Section IV. The candidate core domain can be placed, either alone, or with one or more other candidate changes in a gRNA molecule/Cas9 molecule system known to be functional with a selected target and evaluated.

In an embodiment, the secondary domain nucleotides do not comprise modifications, e.g., modifications of the type provided in Section X. However, in an embodiment, the secondary domain comprises one or more modifications, e.g., modifications that render it less susceptible to degradation or more bio-compatible, e.g., less immunogenic. By way of example, the backbone of the secondary domain can be modified with a phosphorothioate, or other modification(s) from Section X. In an embodiment a nucleotide of the secondary domain can comprise a 2' modification (e.g., a modification at the 2' position on ribose), e.g., a 2-acetylation, e.g., a 2' methylation, or other modification from Section X.

Modifications in the secondary domain can be selected to not interfere with targeting efficacy, which can be evaluated by testing a candidate modification in the system described in Section IV. gRNAs having a candidate secondary domain having a selected length, sequence, degree of complementarity, or degree of modification, can be evaluated in the system described at Section IV. The candidate secondary domain can be placed, either alone, or with one or more other candidate changes in a gRNA molecule/Cas9 molecule system known to be functional with a selected target and evaluated.

In an embodiment, (1) the degree of complementarity between the core domain of the targeting domain and its target (i.e., the core domain target), and (2) the degree of complementarity between the secondary domain of the targeting domain and its target (i.e., the secondary domain target), may differ. In an embodiment, (1) may be greater than (2). In an embodiment, (1) may be less than (2). In an embodiment, (1) and (2) are the same, e.g., each may be completely complementary with its target.

In an embodiment, (1) the number of modifications (e.g., modifications from Section X) of the nucleotides of the core domain and (2) the number of modification (e.g., modifications from Section X) of the nucleotides of the secondary domain, may differ. In an embodiment, (1) may be less than (2). In an embodiment, (1) may be greater than (2). In an embodiment, (1) and (2) may be the same, e.g., each may be free of modifications.

First and Second Complementarity Domains

The first complementarity domain is complementary with the second complementarity domain.

Typically the first domain does not have exact complementarity with the second complementarity domain. In an embodiment, the first complementarity domain can have 1, 2, 3, 4 or 5 nucleotides that are not complementary with the corresponding nucleotide of the second complementarity domain. In an embodiment, 1, 2, 3, 4, 5 or 6, e.g., 3 nucleotides, will not pair in the duplex, and, e.g., form a non-duplexed or looped-out region. In an embodiment, an unpaired, or loop-out, region, e.g., a loop-out of 3 nucleotides, is present on the second complementarity domain. In an embodiment, the unpaired region begins 1, 2, 3, 4, 5, or 6, e.g., 4, nucleotides from the 5' end of the second complementarity domain.

In an embodiment, the degree of complementarity, together with other properties of the gRNA, is sufficient to allow targeting of a Cas9 molecule to the target nucleic acid.

In an embodiment, the first and second complementarity domains are:

independently, 6+/−2, 7+/−2, 8+/−2, 9+/−2, 10+/−2, 11+/−2, 12+/−2, 13+/−2, 14+/−2, 15+/−2, 16+/−2, 17+/−2, 18+/−2, 19+/−2, or 20+/−2, 21+/−2, 22+/−2, 23+/−2, or 24+/−2 nucleotides in length;

independently, 6, 7, 8, 9, 10, 11, 12, 13, 14, 14, 16, 17, 18, 19, 20, 21, 22, 23, 24, 25, or 26 nucleotides in length; or independently, 5 to 24, 5 to 23, 5 to 22, 5 to 21, 5 to 20, 7 to 18, 9 to 16, or 10 to 14 nucleotides in length.

In an embodiment, the second complementarity domain is longer than the first complementarity domain, e.g., 2, 3, 4, 5, or 6, e.g., 6, nucleotides longer.

In an embodiment, the first and second complementary domains, independently, do not comprise modifications, e.g., modifications of the type provided in Section X.

In an embodiment, the first and second complementary domains, independently, comprise one or more modifications, e.g., modifications that the render the domain less susceptible to degradation or more bio-compatible, e.g., less immunogenic. By way of example, the backbone of the domain can be modified with a phosphorothioate, or other modification(s) from Section X. In an embodiment a nucleotide of the domain can comprise a 2' modification (e.g., a modification at the 2' position on ribose), e.g., a 2-acetylation, e.g., a 2' methylation, or other modification(s) from Section X.

In an embodiment, the first and second complementary domains, independently, include 1, 2, 3, 4, 5, 6, 7 or 8 or more modifications. In an embodiment, the first and second complementary domains, independently, include 1, 2, 3, or 4 modifications within 5 nucleotides of its 5' end. In an embodiment, the first and second complementary domains, independently, include as many as 1, 2, 3, or 4 modifications within 5 nucleotides of its 3' end.

In an embodiment, the first and second complementary domains, independently, include modifications at two consecutive nucleotides, e.g., two consecutive nucleotides that are within 5 nucleotides of the 5' end of the domain, within 5 nucleotides of the 3' end of the domain, or more than 5 nucleotides away from one or both ends of the domain. In an embodiment, the first and second complementary domains, independently, include no two consecutive nucleotides that are modified, within 5 nucleotides of the 5' end of the domain, within 5 nucleotides of the 3' end of the domain, or within a region that is more than 5 nucleotides away from one or both ends of the domain. In an embodiment, the first and second complementary domains, independently, include no nucleotide that is modified within 5 nucleotides of the 5' end of the domain, within 5 nucleotides of the 3' end of the domain, or within a region that is more than 5 nucleotides away from one or both ends of the domain.

Modifications in a complementarity domain can be selected to not interfere with targeting efficacy, which can be evaluated by testing a candidate modification in the system described in Section IV. gRNAs having a candidate complementarity domain having a selected length, sequence, degree of complementarity, or degree of modification, can be evaluated in the system described in Section IV. The candidate complementarity domain can be placed, either alone, or with one or more other candidate changes in a gRNA molecule/Cas9 molecule system known to be functional with a selected target and evaluated.

In an embodiment, the first complementarity domain has at least 60, 70, 80, 81, 82, 83, 84, 85, 86, 87, 88, 89, 90, 91, 92, 93, 94, 95, 96, 97, 98, 99% homology with, or differs by no more than 1, 2, 3, 4, 5, or 6 nucleotides from, a reference first complementarity domain, e.g., a naturally occurring, e.g., an S. pyogenes, S. aureus or S. thermophilus, first complementarity domain, or a first complementarity domain described herein.

In an embodiment, the second complementarity domain has at least 60, 70, 80, 81, 82, 83, 84, 85, 86, 87, 88, 89, 90, 91, 92, 93, 94, 95, 96, 97, 98, 99% homology with, or differs by no more than 1, 2, 3, 4, 5, or 6 nucleotides from, a reference second complementarity domain, e.g., a naturally occurring, e.g., an S. pyogenes, S. aureus or S. thermophilus, second complementarity domain, or a second complementarity domain described herein.

The duplexed region formed by first and second complementarity domains is typically 6, 7, 8, 9, 10, 11, 12, 13, 14, 15, 16, 17, 18, 19, 20, 21 or 22 base pairs in length (excluding any looped out or unpaired nucleotides).

In an embodiment, the first and second complementarity domains, when duplexed, comprise 11 paired nucleotides, for example, in the gRNA sequence (one paired strand underlined, one bolded):

```
                                          (SEQ ID NO:__)
NNNNNNNNNNNNNNNNNNNNNNNNNGUUUUAGAGCUAGAAAUAGCAAGUUAAA

AUAAGGCUAGUCCGUUAUCAACUUGAAAAGUGGCACCGAGUCGGUGC.
```

In an embodiment, the first and second complementarity domains, when duplexed, comprise 15 paired nucleotides, for example in the gRNA sequence (one paired strand underlined, one bolded):

```
                                          (SEQ ID NO:__)
NNNNNNNNNNNNNNNNNNNNNNNNNGUUUUAGAGCUAUGCUGAAAAGCAUAGC

AAGUUAAAAUAAGGCUAGUCCGUUAUCAACUUGAAAAGUGGCACCGAG

UCGGUGC.
```

In an embodiment the first and second complementarity domains, when duplexed, comprise 16 paired nucleotides, for example in the gRNA sequence (one paired strand underlined, one bolded):

```
                                          (SEQ ID NO:__)
NNNNNNNNNNNNNNNNNNNNNNNNNGUUUUAGAGCUAUGCUGGAAACAGCAUA

GCAAGUUAAAAUAAGGCUAGUCCGUUAUCAACUUGAAAAGUGGCACCG

AGUCGGUGC.
```

In an embodiment the first and second complementarity domains, when duplexed, comprise 21 paired nucleotides, for example in the gRNA sequence (one paired strand underlined, one bolded):

```
                                          (SEQ ID NO:__)
NNNNNNNNNNNNNNNNNNNNNNNNNGUUUUAGAGCUAUGCUGUUUUGGAAACA

AAACAGCAUAGCAAGUUAAAAUAAGGCUAGUCCGUUAUCAACUUGAAAAA

GUGGCACCGAGUCGGUGC.
```

In an embodiment, nucleotides are exchanged to remove poly-U tracts, for example in the gRNA sequences (exchanged nucleotides underlined):

```
                                          (SEQ ID NO:__)
NNNNNNNNNNNNNNNNNNNNNNNNNGUAUUAGAGCUAGAAAUAGCAAGUUAAU

AUAAGGCUAGUCCGUUAUCAACUUGAAAAAGUGGCACCGAGUCGGUGC;

(SEQ ID NO:__)
NNNNNNNNNNNNNNNNNNNNNNNNNGUUUAAGAGCUAGAAAUAGCAAGUUUAA

AUAAGGCUAGUCCGUUAUCAACUUGAAAAAGUGGCACCGAGUCGGUGC;
or
                                          (SEQ ID NO:__)
NNNNNNNNNNNNNNNNNNNNNNNNNGUAUUAGAGCUAUGCUGUAUUGGAAACA

AUACAGCAUAGCAAGUUAAUAUAAGGCUAGUCCGUUAUCAACUUGAAAAA

GUGGCACCGAGUCGGUGC.
```

5' Extension Domain

In an embodiment, a modular gRNA can comprise additional sequence, 5' to the second complementarity domain. In an embodiment, the 5' extension domain is 2 to 10, 2 to 9, 2 to 8, 2 to 7, 2 to 6, 2 to 5, or 2 to 4 nucleotides in length. In an embodiment, the 5' extension domain is 2, 3, 4, 5, 6, 7, 8, 9, or 10 or more nucleotides in length.

In an embodiment, the 5' extension domain nucleotides do not comprise modifications, e.g., modifications of the type provided in Section X. However, in an embodiment, the 5' extension domain comprises one or more modifications, e.g., modifications that it render it less susceptible to degradation or more bio-compatible, e.g., less immunogenic. By way of example, the backbone of the 5' extension domain can be modified with a phosphorothioate, or other modification(s) from Section X. In an embodiment, a nucleotide of the 5' extension domain can comprise a 2' modification (e.g., a modification at the 2' position on ribose), e.g., a 2-acetylation, e.g., a 2' methylation, or other modification(s) from Section X.

In an embodiment, the 5' extension domain can comprise as many as 1, 2, 3, 4, 5, 6, 7 or 8 modifications. In an embodiment, the 5' extension domain comprises as many as 1, 2, 3, or 4 modifications within 5 nucleotides of its 5' end, e.g., in a modular gRNA molecule. In an embodiment, the 5' extension domain comprises as many as 1, 2, 3, or 4 modifications within 5 nucleotides of its 3' end, e.g., in a modular gRNA molecule.

In an embodiment, the 5' extension domain comprises modifications at two consecutive nucleotides, e.g., two consecutive nucleotides that are within 5 nucleotides of the 5' end of the 5' extension domain, within 5 nucleotides of the 3' end of the 5' extension domain, or more than 5 nucleotides away from one or both ends of the 5' extension domain. In an embodiment, no two consecutive nucleotides are modified within 5 nucleotides of the 5' end of the 5' extension domain, within 5 nucleotides of the 3' end of the 5' extension domain, or within a region that is more than 5 nucleotides away from one or both ends of the 5' extension domain. In an embodiment, no nucleotide is modified within 5 nucleotides of the 5' end of the 5' extension domain, within 5 nucleotides of the 3' end of the 5' extension domain, or within a region that is more than 5 nucleotides away from one or both ends of the 5' extension domain.

Modifications in the 5' extension domain can be selected so as to not interfere with gRNA molecule efficacy, which can be evaluated by testing a candidate modification in the system described in Section IV. gRNAs having a candidate 5' extension domain having a selected length, sequence, degree of complementarity, or degree of modification, can be evaluated in the system described at Section IV. The candidate 5' extension domain can be placed, either alone, or with one or more other candidate changes in a gRNA molecule/Cas9 molecule system known to be functional with a selected target and evaluated.

In an embodiment, the 5' extension domain has at least 60, 70, 80, 81, 82, 83, 84, 85, 86, 87, 88, 89, 90, 91, 92, 93, 94, 95, 96, 97, 98, 99% homology with, or differs by no more than 1, 2, 3, 4, 5, or 6 nucleotides from, a reference 5' extension domain, e.g., a naturally occurring, e.g., an *S. pyogenes, S. aureus* or *S. thermophilus,* 5' extension domain, or a 5' extension domain described herein.

Linking Domain

In a unimolecular gRNA molecule the linking domain is disposed between the first and second complementarity domains. In a modular gRNA molecule, the two molecules are associated with one another by the complementarity domains.

In an embodiment, the linking domain is 10+/−5, 20+/−5, 30+/−5, 40+/−5, 50+/−5, 60+/−5, 70+/−5, 80+/−5, 90+/−5, or 100+/−5 nucleotides, in length. In an embodiment, the linking domain is 20+/−10, 30+/−10, 40+/−10, 50+/−10, 60+/−10, 70+/−10, 80+/−10, 90+/−10, or 100+/−10 nucleotides, in length.

In an embodiment, the linking domain is 10 to 100, 10 to 90, 10 to 80, 10 to 70, 10 to 60, 10 to 50, 10 to 40, 10 to 30, 10 to 20 or 10 to 15 nucleotides in length.

In another embodiment, the linking domain is 20 to 100, 20 to 90, 20 to 80, 20 to 70, 20 to 60, 20 to 50, 20 to 40, 20 to 30, or 20 to 25 nucleotides in length.

In an embodiment, the linking domain is 1, 2, 3, 4, 5, 6, 7, 8, 9, 10, 11, 12, 13, 14, 15, 16 17, 18, 19, or 20 nucleotides in length.

In and embodiment, the linking domain is a covalent bond.

In an embodiment, the linking domain comprises a duplexed region, typically adjacent to or within 1, 2, or 3 nucleotides of the 3' end of the first complementarity domain and/or the 5-end of the second complementarity domain. In an embodiment, the duplexed region can be 20+/−10 base pairs in length. In an embodiment, the duplexed region can be 10+/−5, 15+/−5, 20+/−5, or 30+/−5 base pairs in length. In an embodiment, the duplexed region can be 1, 2, 3, 4, 5, 6, 7, 8, 9, 10, 11, 12, 13, 14, or 15 base pairs in length. Typically the sequences forming the duplexed region have exact complementarity with one another, though in an embodiment as many as 1, 2, 3, 4, 5, 6, 7 or 8 nucleotides are not complementary with the corresponding nucleotides.

In an embodiment, the linking domain nucleotides do not comprise modifications, e.g., modifications of the type provided in Section X. However, in an embodiment, the linking domain comprises one or more modifications, e.g., modifications that it render it less susceptible to degradation or more bio-compatible, e.g., less immunogenic. By way of example, the backbone of the linking domain can be modified with a phosphorothioate, or other modification(s) from Section X. In an embodiment a nucleotide of the linking domain can comprise a 2' modification (e.g., a modification at the 2' position on ribose), e.g., a 2-acetylation, e.g., a 2' methylation, or other modification(s) from Section X. In an embodiment, the linking domain can comprise as many as 1, 2, 3, 4, 5, 6, 7 or 8 modifications.

Modifications in a linking domain can be selected so as to not interfere with targeting efficacy, which can be evaluated by testing a candidate modification in the system described in Section IV. gRNAs having a candidate linking domain having a selected length, sequence, degree of complementarity, or degree of modification, can be evaluated a system described in Section IV. A candidate linking domain can be placed, either alone, or with one or more other candidate changes in a gRNA molecule/Cas9 molecule system known to be functional with a selected target and evaluated.

In an embodiment, the linking domain has at least 60, 70, 80, 81, 82, 83, 84, 85, 86, 87, 88, 89, 90, 91, 92, 93, 94, 95, 96, 97, 98, 99% homology with, or differs by no more than 1, 2, 3, 4, 5, or 6 nucleotides from, a reference linking domain, e.g., a linking domain described herein.

Proximal Domain

In an embodiment, the proximal domain is 6+/−2, 7+/−2, 8+/−2, 9+/−2, 10+/−2, 11+/−2, 12+/−2, 13+/−2, 14+/−2, 14+/−2, 16+/−2, 17+/−2, 18+/−2, 19+/−2, or 20+/−2 nucleotides in length.

In an embodiment, the proximal domain is 6, 7, 8, 9, 10, 11, 12, 13, 14, 15, 16, 17, 18, 19, 20, 21, 22, 23, 24, 25 or 26 nucleotides in length.

In an embodiment, the proximal domain is 5 to 20, 7, to 18, 9 to 16, or 10 to 14 nucleotides in length.

In an embodiment, the proximal domain nucleotides do not comprise modifications, e.g., modifications of the type provided in Section X. However, in an embodiment, the proximal domain comprises one or more modifications, e.g., modifications that it render it less susceptible to degradation or more bio-compatible, e.g., less immunogenic. By way of example, the backbone of the proximal domain can be modified with a phosphorothioate, or other modification(s) from Section X. In an embodiment a nucleotide of the proximal domain can comprise a 2' modification (e.g., a modification at the 2' position on ribose), e.g., a 2-acetylation, e.g., a 2' methylation, or other modification(s) from Section X.

In an embodiment, the proximal domain can comprise as many as 1, 2, 3, 4, 5, 6, 7 or 8 modifications. In an embodiment, the proximal domain comprises as many as 1, 2, 3, or 4 modifications within 5 nucleotides of its 5' end, e.g., in a modular gRNA molecule. In an embodiment, the target domain comprises as many as 1, 2, 3, or 4 modifications within 5 nucleotides of its 3' end, e.g., in a modular gRNA molecule.

In an embodiment, the proximal domain comprises modifications at two consecutive nucleotides, e.g., two consecutive nucleotides that are within 5 nucleotides of the 5' end of the proximal domain, within 5 nucleotides of the 3' end of the proximal domain, or more than 5 nucleotides away from one or both ends of the proximal domain. In an embodiment, no two consecutive nucleotides are modified within 5 nucleotides of the 5' end of the proximal domain, within 5 nucleotides of the 3' end of the proximal domain, or within a region that is more than 5 nucleotides away from one or both ends of the proximal domain. In an embodiment, no nucleotide is modified within 5 nucleotides of the 5' end of the proximal domain, within 5 nucleotides of the 3' end of the proximal domain, or within a region that is more than 5 nucleotides away from one or both ends of the proximal domain.

Modifications in the proximal domain can be selected so as to not interfere with gRNA molecule efficacy, which can be evaluated by testing a candidate modification in the system described in Section IV. gRNAs having a candidate proximal domain having a selected length, sequence, degree of complementarity, or degree of modification, can be evaluated in the system described at Section IV. The candidate proximal domain can be placed, either alone, or with one or more other candidate changes in a gRNA molecule/Cas9 molecule system known to be functional with a selected target and evaluated.

In an embodiment, the proximal domain has at least 60, 70, 80, 81, 82, 83, 84, 85, 86, 87, 88, 89, 90, 91, 92, 93, 94, 95, 96, 97, 98, 99% homology with, or differs by no more than 1, 2, 3, 4, 5, or 6 nucleotides from, a reference proximal domain, e.g., a naturally occurring, e.g., an S. pyogenes, S. aureus or S. thermophilus, proximal domain, or a proximal domain described herein.

Tail Domain

In an embodiment, the tail domain is 10+/−5, 20+/−5, 30+/−5, 40+/−5, 50+/−5, 60+/−5, 70+/−5, 80+/−5, 90+/−5, or 100+/−5 nucleotides, in length.

In an embodiment, the tail domain is 20+/−5 nucleotides in length.

In an embodiment, the tail domain is 20+/−10, 30+/−10, 40+/−10, 50+/−10, 60+/−10, 70+/−10, 80+/−10, 90+/−10, or 100+/−10 nucleotides, in length.

In an embodiment, the tail domain is 25+/−10 nucleotides in length.

In an embodiment, the tail domain is 10 to 100, 10 to 90, 10 to 80, 10 to 70, 10 to 60, 10 to 50, 10 to 40, 10 to 30, 10 to 20 or 10 to 15 nucleotides in length.

In another embodiment, the tail domain is 20 to 100, 20 to 90, 20 to 80, 20 to 70, 20 to 60, 20 to 50, 20 to 40, 20 to 30, or 20 to 25 nucleotides in length.

In an embodiment, the tail domain is 1 to 20, 1 to 15, 1 to 10, or 1 to 5 nucleotides in length.

In an embodiment, the tail domain nucleotides do not comprise modifications, e.g., modifications of the type provided in Section X. However, in an embodiment, the tail domain comprises one or more modifications, e.g., modifications that it render it less susceptible to degradation or more bio-compatible, e.g., less immunogenic. By way of example, the backbone of the tail domain can be modified with a phosphorothioate, or other modification(s) from Section X. In an embodiment, a nucleotide of the tail domain can comprise a 2' modification (e.g., a modification at the 2' position on ribose), e.g., a 2-acetylation, e.g., a 2' methylation, or other modification(s) from Section X.

In an embodiment, the tail domain can have as many as 1, 2, 3, 4, 5, 6, 7 or 8 modifications. In an embodiment, the target domain comprises as many as 1, 2, 3, or 4 modifications within 5 nucleotides of its 5' end. In an embodiment, the target domain comprises as many as 1, 2, 3, or 4 modifications within 5 nucleotides of its 3' end.

In an embodiment, the tail domain comprises a tail duplex domain, which can form a tail duplexed region. In an embodiment, the tail duplexed region can be 3, 4, 5, 6, 7, 8, 9, 10, 11, or 12 base pairs in length. In an embodiment, a further single stranded domain, exists 3' to the tail duplexed domain. In an embodiment, this domain is 3, 4, 5, 6, 7, 8, 9, or 10 nucleotides in length. In an embodiment it is 4 to 6 nucleotides in length.

In an embodiment, the tail domain has at least 60, 70, 80, 81, 82, 83, 84, 85, 86, 87, 88, 89, 90, 91, 92, 93, 94, 95, 96, 97, 98, 99% homology with, or differs by no more than 1, 2, 3, 4, 5, or 6 nucleotides from, a reference tail domain, e.g., a naturally occurring, e.g., an S. pyogenes, S. aureus or S. thermophilus, tail domain, or a tail domain described herein.

In an embodiment, the proximal and tail domain, taken together comprise the following sequences:

(SEQ ID NO: __)
AAGGCUAGUCCGUUAUCAACUUGAAAAAGUGGCACCGAGUCGGUGCU,
or (SEQ ID NO: __)
AAGGCUAGUCCGUUAUCAACUUGAAAAAGUGGCACCGAGUCGGUGGUGC,
or (SEQ ID NO: __)
AAGGCUAGUCCGUUAUCAACUUGAAAAAGUGGCACCGAGUCGGUGCGGAUC,
or (SEQ ID NO: __)
AAGGCUAGUCCGUUAUCAACUUGAAAAAGUG,
or (SEQ ID NO: __)
AAGGCUAGUCCGUUAUCA,
or (SEQ ID NO: __)
AAGGCUAGUCCG.

In an embodiment, the tail domain comprises the 3' sequence UUUUUU, e.g., if a U6 promoter is used for transcription.

In an embodiment, the tail domain comprises the 3' sequence UUUU, e.g., if an H1 promoter is used for transcription.

In an embodiment, tail domain comprises variable numbers of 3' Us depending, e.g., on the termination signal of the pol-III promoter used.

In an embodiment, the tail domain comprises variable 3' sequence derived from the DNA template if a T7 promoter is used.

In an embodiment, the tail domain comprises variable 3' sequence derived from the DNA template, e.g., if in vitro transcription is used to generate the RNA molecule.

In an embodiment, the tail domain comprises variable 3' sequence derived from the DNA template, e.g., if a pol-II promoter is used to drive transcription.

Modifications in the tail domain can be selected to not interfere with targeting efficacy, which can be evaluated by testing a candidate modification in the system described in Section IV. gRNAs having a candidate tail domain having a selected length, sequence, degree of complementarity, or degree of modification, can be evaluated in the system described in Section IV. The candidate tail domain can be placed, either alone, or with one or more other candidate changes in a gRNA molecule/Cas9 molecule system known to be functional with a selected target and evaluated.

In an embodiment, the tail domain comprises modifications at two consecutive nucleotides, e.g., two consecutive nucleotides that are within 5 nucleotides of the 5' end of the tail domain, within 5 nucleotides of the 3' end of the tail domain, or more than 5 nucleotides away from one or both ends of the tail domain. In an embodiment, no two consecutive nucleotides are modified within 5 nucleotides of the 5' end of the tail domain, within 5 nucleotides of the 3' end of the tail domain, or within a region that is more than 5 nucleotides away from one or both ends of the tail domain. In an embodiment, no nucleotide is modified within 5 nucleotides of the 5' end of the tail domain, within 5 nucleotides of the 3' end of the tail domain, or within a region that is more than 5 nucleotides away from one or both ends of the tail domain.

In an embodiment a gRNA has the following structure:

5' [targeting domain]-[first complementarity domain]-[linking domain]-[second complementarity domain]-[proximal domain]-[tail domain]-3' wherein, the targeting domain comprises a core domain and optionally a secondary domain, and is 10 to 50 nucleotides in length;

the first complementarity domain is 5 to 25 nucleotides in length and, In an embodiment has at least 50, 60, 70, 80, 81, 82, 83, 84, 85, 86, 87, 88, 89, 90, 91, 92, 93, 94, 95, 96, 97, 98, 99% homology with a reference first complementarity domain disclosed herein;

the linking domain is 1 to 5 nucleotides in length;

the second complementarity domain is 5 to 27 nucleotides in length and, in an embodiment has at least 50, 60, 70, 80, 81, 82, 83, 84, 85, 86, 87, 88, 89, 90, 91, 92, 93, 94, 95, 96, 97, 98, 99% homology with a reference second complementarity domain disclosed herein;

the proximal domain is 5 to 20 nucleotides in length and, in an embodiment has at least 50, 60, 70, 80, 81, 82, 83, 84, 85, 86, 87, 88, 89, 90, 91, 92, 93, 94, 95, 96, 97, 98, 99% homology with a reference proximal domain disclosed herein; and the tail domain is absent or a nucleotide sequence is 1 to 50 nucleotides in length and, in an embodiment has at least 60, 70, 80, 81, 82, 83, 84, 85, 86, 87, 88, 89, 90, 91, 92, 93, 94, 95, 96, 97, 98, 99% homology with a reference tail domain disclosed herein.

Exemplary Chimeric gRNAs

In an embodiment, a unimolecular, or chimeric, gRNA comprises, preferably from 5' to 3':

a targeting domain (which is complementary to a target nucleic acid);
a first complementarity domain, e.g., comprising 15, 16, 17, 18, 19, 20, 21, 22, 23, 24, 25, or 26 nucleotides;
a linking domain;
a second complementarity domain (which is complementary to the first complementarity domain);
a proximal domain; and
a tail domain,
wherein,
(a) the proximal and tail domain, when taken together, comprise at least 15, 18, 20, 25, 30, 31, 35, 40, 45, 49, 50, or 53 nucleotides;
(b) there are at least 15, 18, 20, 25, 30, 31, 35, 40, 45, 49, 50, or 53 nucleotides 3' to the last nucleotide of the second complementarity domain; or
(c) there are at least 16, 19, 21, 26, 31, 32, 36, 41, 46, 50, 51, or 54 nucleotides 3' to the last nucleotide of the second complementarity domain that is complementary to its corresponding nucleotide of the first complementarity domain.

In an embodiment, the sequence from (a), (b), or (c), has at least 60, 70, 80, 81, 82, 83, 84, 85, 86, 87, 88, 89, 90, 91, 92, 93, 94, 95, 96, 97, 98, 99% homology with the corresponding sequence of a naturally occurring gRNA, or with a gRNA described herein.

In an embodiment, the proximal and tail domain, when taken together, comprise at least 15, 18, 20, 25, 30, 31, 35, 40, 45, 49, 50, or 53 nucleotides.

In an embodiment, there are at least 15, 18, 20, 25, 30, 31, 35, 40, 45, 49, 50, or 53 nucleotides 3' to the last nucleotide of the second complementarity domain.

In an embodiment, there are at least 16, 19, 21, 26, 31, 32, 36, 41, 46, 50, 51, or 54 nucleotides 3' to the last nucleotide of the second complementarity domain that is complementary to its corresponding nucleotide of the first complementarity domain.

In an embodiment, the targeting domain comprises, has, or consists of, 16, 17, 18, 19, 20, 21, 22, 23, 24, 25 or 26 nucleotides (e.g., 16, 17, 18, 19, 20, 21, 22, 23, 24, 25 or 26 consecutive nucleotides) having complementarity with the target domain, e.g., the targeting domain is 16, 17, 18, 19, 20, 21, 22, 23, 24, 25, or 26 nucleotides in length.

In an embodiment, the targeting domain comprises, has, or consists of, 16 nucleotides (e.g., 16 consecutive nucleotides) having complementarity with the target domain, e.g., the targeting domain is 16 nucleotides in length.

In an embodiment, the targeting domain comprises, has, or consists of, 17 nucleotides (e.g., 17 consecutive nucleotides) having complementarity with the target domain, e.g., the targeting domain is 17 nucleotides in length.

In an embodiment, the targeting domain comprises, has, or consists of, 18 nucleotides (e.g., 18 consecutive nucleotides) having complementarity with the target domain, e.g., the targeting domain is 18 nucleotides in length.

In an embodiment, the targeting domain comprises, has, or consists of, 19 nucleotides (e.g., 19 consecutive nucleotides) having complementarity with the target domain, e.g., the targeting domain is 19 nucleotides in length.

In an embodiment, the targeting domain comprises, has, or consists of, 20 nucleotides (e.g., 20 consecutive nucleotides) having complementarity with the target domain, e.g., the targeting domain is 20 nucleotides in length.

In an embodiment, the targeting domain comprises, has, or consists of, 21 nucleotides (e.g., 21 consecutive nucleotides) having complementarity with the target domain, e.g., the targeting domain is 21 nucleotides in length.

In an embodiment, the targeting domain comprises, has, or consists of, 22 nucleotides (e.g., 22 consecutive nucleotides) having complementarity with the target domain, e.g., the targeting domain is 22 nucleotides in length.

In an embodiment, the targeting domain comprises, has, or consists of, 23 nucleotides (e.g., 23 consecutive nucleotides) having complementarity with the target domain, e.g., the targeting domain is 23 nucleotides in length.

In an embodiment, the targeting domain comprises, has, or consists of, 24 nucleotides (e.g., 24 consecutive nucleotides) having complementarity with the target domain, e.g., the targeting domain is 24 nucleotides in length.

In an embodiment, the targeting domain comprises, has, or consists of, 25 nucleotides (e.g., 25 consecutive nucleotides) having complementarity with the target domain, e.g., the targeting domain is 25 nucleotides in length.

In an embodiment, the targeting domain comprises, has, or consists of, 26 nucleotides (e.g., 26 consecutive nucleotides) having complementarity with the target domain, e.g., the targeting domain is 26 nucleotides in length.

In an embodiment, the targeting domain comprises, has, or consists of, 16 nucleotides (e.g., 16 consecutive nucleotides) having complementarity with the target domain, e.g., the targeting domain is 16 nucleotides in length; and the proximal and tail domain, when taken together, comprise at least 15, 18, 20, 25, 30, 31, 35, 40, 45, 49, 50, or 53 nucleotides.

In an embodiment, the targeting domain comprises, has, or consists of, 16 nucleotides (e.g., 16 consecutive nucleotides) having complementarity with the target domain, e.g., the targeting domain is 16 nucleotides in length; and there are at least 15, 18, 20, 25, 30, 31, 35, 40, 45, 49, 50, or 53 nucleotides 3' to the last nucleotide of the second complementarity domain.

In an embodiment, the targeting domain comprises, has, or consists of, 16 nucleotides (e.g., 16 consecutive nucleotides) having complementarity with the target domain, e.g., the targeting domain is 16 nucleotides in length; and there are at least 16, 19, 21, 26, 31, 32, 36, 41, 46, 50, 51, or 54 nucleotides 3' to the last nucleotide of the second complementarity domain that is complementary to its corresponding nucleotide of the first complementarity domain.

In an embodiment, the targeting domain comprises, has, or consists of, 17 nucleotides (e.g., 17 consecutive nucleotides) having complementarity with the target domain, e.g., the targeting domain is 17 nucleotides in length; and the proximal and tail domain, when taken together, comprise at least 15, 18, 20, 25, 30, 31, 35, 40, 45, 49, 50, or 53 nucleotides.

In an embodiment, the targeting domain comprises, has, or consists of, 17 nucleotides (e.g., 17 consecutive nucleotides) having complementarity with the target domain, e.g., the targeting domain is 17 nucleotides in length; and there are at least 15, 18, 20, 25, 30, 31, 35, 40, 45, 49, 50, or 53 nucleotides 3' to the last nucleotide of the second complementarity domain.

In an embodiment, the targeting domain comprises, has, or consists of, 17 nucleotides (e.g., 17 consecutive nucleotides) having complementarity with the target domain, e.g., the targeting domain is 17 nucleotides in length; and there are at least 16, 19, 21, 26, 31, 32, 36, 41, 46, 50, 51, or 54 nucleotides 3' to the last nucleotide of the second complementarity domain that is complementary to its corresponding nucleotide of the first complementarity domain.

In an embodiment, the targeting domain comprises, has, or consists of, 18 nucleotides (e.g., 18 consecutive nucleotides) having complementarity with the target domain, e.g., the targeting domain is 18 nucleotides in length; and the proximal and tail domain, when taken together, comprise at least 15, 18, 20, 25, 30, 31, 35, 40, 45, 49, 50, or 53 nucleotides.

In an embodiment, the targeting domain comprises, has, or consists of, 18 nucleotides (e.g., 18 consecutive nucleotides) having complementarity with the target domain, e.g., the targeting domain is 18 nucleotides in length; and there are at least 15, 18, 20, 25, 30, 31, 35, 40, 45, 49, 50, or 53 nucleotides 3' to the last nucleotide of the second complementarity domain.

In an embodiment, the targeting domain comprises, has, or consists of, 18 nucleotides (e.g., 18 consecutive nucleotides) having complementarity with the target domain, e.g., the targeting domain is 18 nucleotides in length; and there are at least 16, 19, 21, 26, 31, 32, 36, 41, 46, 50, 51, or 54 nucleotides 3' to the last nucleotide of the second complementarity domain that is complementary to its corresponding nucleotide of the first complementarity domain.

In an embodiment, the targeting domain comprises, has, or consists of, 19 nucleotides (e.g., 19 consecutive nucleotides) having complementarity with the target domain, e.g., the targeting domain is 19 nucleotides in length; and the proximal and tail domain, when taken together, comprise at least 15, 18, 20, 25, 30, 31, 35, 40, 45, 49, 50, or 53 nucleotides.

In an embodiment, the targeting domain comprises, has, or consists of, 19 nucleotides (e.g., 19 consecutive nucleotides) having complementarity with the target domain, e.g., the targeting domain is 19 nucleotides in length; and there are at least 15, 18, 20, 25, 30, 31, 35, 40, 45, 49, 50, or 53 nucleotides 3' to the last nucleotide of the second complementarity domain.

In an embodiment, the targeting domain comprises, has, or consists of, 19 nucleotides (e.g., 19 consecutive nucleotides) having complementarity with the target domain, e.g., the targeting domain is 19 nucleotides in length; and there are at least 16, 19, 21, 26, 31, 32, 36, 41, 46, 50, 51, or 54 nucleotides 3' to the last nucleotide of the second complementarity domain that is complementary to its corresponding nucleotide of the first complementarity domain.

In an embodiment, the targeting domain comprises, has, or consists of, 20 nucleotides (e.g., 20 consecutive nucleotides) having complementarity with the target domain, e.g., the targeting domain is 20 nucleotides in length; and the proximal and tail domain, when taken together, comprise at least 15, 18, 20, 25, 30, 31, 35, 40, 45, 49, 50, or 53 nucleotides.

In an embodiment, the targeting domain comprises, has, or consists of, 20 nucleotides (e.g., 20 consecutive nucleotides) having complementarity with the target domain, e.g., the targeting domain is 20 nucleotides in length; and there are at least 15, 18, 20, 25, 30, 31, 35, 40, 45, 49, 50, or 53 nucleotides 3' to the last nucleotide of the second complementarity domain.

In an embodiment, the targeting domain comprises, has, or consists of, 20 nucleotides (e.g., 20 consecutive nucleotides) having complementarity with the target domain, e.g., the targeting domain is 20 nucleotides in length; and there are at least 16, 19, 21, 26, 31, 32, 36, 41, 46, 50, 51, or 54 nucleotides 3' to the last nucleotide of the second complementarity domain that is complementary to its corresponding nucleotide of the first complementarity domain.

In an embodiment, the targeting domain comprises, has, or consists of, 21 nucleotides (e.g., 21 consecutive nucleotides) having complementarity with the target domain, e.g., the targeting domain is 21 nucleotides in length; and the proximal and tail domain, when taken together, comprise at least 15, 18, 20, 25, 30, 31, 35, 40, 45, 49, 50, or 53 nucleotides.

In an embodiment, the targeting domain comprises, has, or consists of, 21 nucleotides (e.g., 21 consecutive nucleotides) having complementarity with the target domain, e.g., the targeting domain is 21 nucleotides in length; and there are at least 15, 18, 20, 25, 30, 31, 35, 40, 45, 49, 50, or 53 nucleotides 3' to the last nucleotide of the second complementarity domain.

In an embodiment, the targeting domain comprises, has, or consists of, 21 nucleotides (e.g., 21 consecutive nucleotides) having complementarity with the target domain, e.g., the targeting domain is 21 nucleotides in length; and there are at least 16, 19, 21, 26, 31, 32, 36, 41, 46, 50, 51, or 54 nucleotides 3' to the last nucleotide of the second complementarity domain that is complementary to its corresponding nucleotide of the first complementarity domain.

In an embodiment, the targeting domain comprises, has, or consists of, 22 nucleotides (e.g., 22 consecutive nucleotides) having complementarity with the target domain, e.g., the targeting domain is 22 nucleotides in length; and the proximal and tail domain, when taken together, comprise at least 15, 18, 20, 25, 30, 31, 35, 40, 45, 49, 50, or 53 nucleotides.

In an embodiment, the targeting domain comprises, has, or consists of, 22 nucleotides (e.g., 22 consecutive nucleotides) having complementarity with the target domain, e.g., the targeting domain is 22 nucleotides in length; and there are at least 15, 18, 20, 25, 30, 31, 35, 40, 45, 49, 50, or 53 nucleotides 3' to the last nucleotide of the second complementarity domain.

In an embodiment, the targeting domain comprises, has, or consists of, 22 nucleotides (e.g., 22 consecutive nucleotides) having complementarity with the target domain, e.g., the targeting domain is 22 nucleotides in length; and there are at least 16, 19, 21, 26, 31, 32, 36, 41, 46, 50, 51, or 54 nucleotides 3' to the last nucleotide of the second complementarity domain that is complementary to its corresponding nucleotide of the first complementarity domain.

In an embodiment, the targeting domain comprises, has, or consists of, 23 nucleotides (e.g., 23 consecutive nucleotides) having complementarity with the target domain, e.g., the targeting domain is 23 nucleotides in length; and the proximal and tail domain, when taken together, comprise at least 15, 18, 20, 25, 30, 31, 35, 40, 45, 49, 50, or 53 nucleotides.

In an embodiment, the targeting domain comprises, has, or consists of, 23 nucleotides (e.g., 23 consecutive nucleotides) having complementarity with the target domain, e.g., the targeting domain is 23 nucleotides in length; and there are at least 15, 18, 20, 25, 30, 31, 35, 40, 45, 49, 50, or 53 nucleotides 3' to the last nucleotide of the second complementarity domain.

In an embodiment, the targeting domain comprises, has, or consists of, 23 nucleotides (e.g., 23 consecutive nucleotides) having complementarity with the target domain, e.g., the targeting domain is 23 nucleotides in length; and there are at least 16, 19, 21, 26, 31, 32, 36, 41, 46, 50, 51, or 54 nucleotides 3' to the last nucleotide of the second complementarity domain that is complementary to its corresponding nucleotide of the first complementarity domain.

In an embodiment, the targeting domain comprises, has, or consists of, 24 nucleotides (e.g., 24 consecutive nucleotides) having complementarity with the target domain, e.g., the targeting domain is 24 nucleotides in length; and the proximal and tail domain, when taken together, comprise at least 15, 18, 20, 25, 30, 31, 35, 40, 45, 49, 50, or 53 nucleotides.

In an embodiment, the targeting domain comprises, has, or consists of, 24 nucleotides (e.g., 24 consecutive nucleotides) having complementarity with the target domain, e.g., the targeting domain is 24 nucleotides in length; and there are at least 15, 18, 20, 25, 30, 31, 35, 40, 45, 49, 50, or 53 nucleotides 3' to the last nucleotide of the second complementarity domain.

In an embodiment, the targeting domain comprises, has, or consists of, 24 nucleotides (e.g., 24 consecutive nucleotides) having complementarity with the target domain, e.g., the targeting domain is 24 nucleotides in length; and there are at least 16, 19, 21, 26, 31, 32, 36, 41, 46, 50, 51, or 54 nucleotides 3' to the last nucleotide of the second complementarity domain that is complementary to its corresponding nucleotide of the first complementarity domain.

In an embodiment, the targeting domain comprises, has, or consists of, 25 nucleotides (e.g., 25 consecutive nucleotides) having complementarity with the target domain, e.g., the targeting domain is 25 nucleotides in length; and the proximal and tail domain, when taken together, comprise at least 15, 18, 20, 25, 30, 31, 35, 40, 45, 49, 50, or 53 nucleotides.

In an embodiment, the targeting domain comprises, has, or consists of, 25 nucleotides (e.g., 25 consecutive nucleotides) having complementarity with the target domain, e.g., the targeting domain is 25 nucleotides in length; and there are at least 15, 18, 20, 25, 30, 31, 35, 40, 45, 49, 50, or 53 nucleotides 3' to the last nucleotide of the second complementarity domain.

In an embodiment, the targeting domain comprises, has, or consists of, 25 nucleotides (e.g., 25 consecutive nucleotides) having complementarity with the target domain, e.g., the targeting domain is 25 nucleotides in length; and there are at least 16, 19, 21, 26, 31, 32, 36, 41, 46, 50, 51, or 54 nucleotides 3' to the last nucleotide of the second complementarity domain that is complementary to its corresponding nucleotide of the first complementarity domain.

In an embodiment, the targeting domain comprises, has, or consists of, 26 nucleotides (e.g., 26 consecutive nucleotides) having complementarity with the target domain, e.g., the targeting domain is 26 nucleotides in length; and the proximal and tail domain, when taken together, comprise at least 15, 18, 20, 25, 30, 31, 35, 40, 45, 49, 50, or 53 nucleotides.

In an embodiment, the targeting domain comprises, has, or consists of, 26 nucleotides (e.g., 26 consecutive nucleotides) having complementarity with the target domain, e.g., the targeting domain is 26 nucleotides in length; and there are at least 15, 18, 20, 25, 30, 31, 35, 40, 45, 49, 50, or 53 nucleotides 3' to the last nucleotide of the second complementarity domain.

In an embodiment, the targeting domain comprises, has, or consists of, 26 nucleotides (e.g., 26 consecutive nucleotides) having complementarity with the target domain, e.g., the targeting domain is 26 nucleotides in length; and there are at least 16, 19, 21, 26, 31, 32, 36, 41, 46, 50, 51, or 54 nucleotides 3' to the last nucleotide of the second complementarity domain that is complementary to its corresponding nucleotide of the first complementarity domain.

In an embodiment, the unimolecular, or chimeric, gRNA molecule (comprising a targeting domain, a first complementary domain, a linking domain, a second complementary domain, a proximal domain and, optionally, a tail domain) comprises the following sequence in which the targeting domain is depicted as 20 Ns but could be any sequence and range in length from 16 to 26 nucleotides and in which the gRNA sequence is followed by 6 Us, which serve as a termination signal for the U6 promoter, but which could be either absent or fewer in number:

```
                                          (SEQ ID NO: __)
NNNNNNNNNNNNNNNNNNNNGUUUUAGAGCUAGAAAUAGCAAGUUAAA

AUAAGGCUAGUCCGUUAUCAACUUGAAAAAGUGGCACCGAGUCGGUGCUU

UUUU.
```

In an embodiment, the unimolecular, or chimeric, gRNA molecule is a *S. pyogenes* gRNA molecule.

In some embodiments, the unimolecular, or chimeric, gRNA molecule (comprising a targeting domain, a first complementary domain, a linking domain, a second complementary domain, a proximal domain and, optionally, a tail domain) comprises the following sequence in which the targeting domain is depicted as 20 Ns but could be any sequence and range in length from 16 to 26 nucleotides and in which the gRNA sequence is followed by 6 Us, which serve as a termination signal for the U6 promoter, but which could be either absent or fewer in number:

(SEQ ID NO: __)
NNNNNNNNNNNNNNNNNNNNNNNGUUUUAGUACUCUGGAAACAGAAUCUAC

UAAAACAAGGCAAAAUGCCGUGUUUAUCUCGUCAACUUGUUGGCGAGAUU

UUUU.

In an embodiment, the unimolecular, or chimeric, gRNA molecule is a *S. aureus* gRNA molecule.

Exemplary Modular gRNAs

In an embodiment, a modular gRNA comprises:
a first strand comprising, preferably from 5' to 3';
a targeting domain, e.g., comprising 15, 16, 17, 18, 19, 20, 21, 22, 23, 24, 25, or 26 nucleotides;
a first complementarity domain; and
a second strand, comprising, preferably from 5' to 3':
optionally a 5' extension domain;
a second complementarity domain;
a proximal domain; and
a tail domain,
wherein:
(a) the proximal and tail domain, when taken together, comprise at least 15, 18, 20, 25, 30, 31, 35, 40, 45, 49, 50, or 53 nucleotides;
(b) there are at least 15, 18, 20, 25, 30, 31, 35, 40, 45, 49, 50, or 53 nucleotides 3' to the last nucleotide of the second complementarity domain; or
(c) there are at least 16, 19, 21, 26, 31, 32, 36, 41, 46, 50, 51, or 54 nucleotides 3' to the last nucleotide of the second complementarity domain that is complementary to its corresponding nucleotide of the first complementarity domain.

In an embodiment, the sequence from (a), (b), or (c), has at least 60, 75, 80, 85, 90, 95, or 99% homology with the corresponding sequence of a naturally occurring gRNA, or with a gRNA described herein.

In an embodiment, the proximal and tail domain, when taken together, comprise at least 15, 18, 20, 25, 30, 31, 35, 40, 45, 49, 50, or 53 nucleotides.

In an embodiment, there are at least 15, 18, 20, 25, 30, 31, 35, 40, 45, 49, 50, or 53 nucleotides 3' to the last nucleotide of the second complementarity domain.

In an embodiment, there are at least 16, 19, 21, 26, 31, 32, 36, 41, 46, 50, 51, or 54 nucleotides 3' to the last nucleotide of the second complementarity domain that is complementary to its corresponding nucleotide of the first complementarity domain.

In an embodiment, the targeting domain comprises, has, or consists of, 16, 17, 18, 19, 20, 21, 22, 23, 24, 25 or 26 nucleotides (e.g., 16, 17, 18, 19, 20, 21, 22, 23, 24, 25 or 26 consecutive nucleotides) having complementarity with the target domain, e.g., the targeting domain is 16, 17, 18, 19, 20, 21, 22, 23, 24, 25 or 26 nucleotides in length.

In an embodiment, the targeting domain comprises, has, or consists of, 16 nucleotides (e.g., 16 consecutive nucleotides) having complementarity with the target domain, e.g., the targeting domain is 16 nucleotides in length.

In an embodiment, the targeting domain comprises, has, or consists of, 17 nucleotides (e.g., 17 consecutive nucleotides) having complementarity with the target domain, e.g., the targeting domain is 17 nucleotides in length.

In an embodiment, the targeting domain comprises, has, or consists of, 18 nucleotides (e.g., 18 consecutive nucleotides) having complementarity with the target domain, e.g., the targeting domain is 18 nucleotides in length.

In an embodiment, the targeting domain comprises, has, or consists of, 19 nucleotides (e.g., 19 consecutive nucleo-tides) having complementarity with the target domain, e.g., the targeting domain is 19 nucleotides in length.

In an embodiment, the targeting domain comprises, has, or consists of, 20 nucleotides (e.g., 20 consecutive nucleotides) having complementarity with the target domain, e.g., the targeting domain is 20 nucleotides in length.

In an embodiment, the targeting domain comprises, has, or consists of, 21 nucleotides (e.g., 21 consecutive nucleotides) having complementarity with the target domain, e.g., the targeting domain is 21 nucleotides in length.

In an embodiment, the targeting domain comprises, has, or consists of, 22 nucleotides (e.g., 22 consecutive nucleotides) having complementarity with the target domain, e.g., the targeting domain is 22 nucleotides in length.

In an embodiment, the targeting domain comprises, has, or consists of, 23 nucleotides (e.g., 23 consecutive nucleotides) having complementarity with the target domain, e.g., the targeting domain is 23 nucleotides in length.

In an embodiment, the targeting domain comprises, has, or consists of, 24 nucleotides (e.g., 24 consecutive nucleotides) having complementarity with the target domain, e.g., the targeting domain is 24 nucleotides in length.

In an embodiment, the targeting domain comprises, has, or consists of, 25 nucleotides (e.g., 25 consecutive nucleotides) having complementarity with the target domain, e.g., the targeting domain is 5 nucleotides in length.

In an embodiment, the targeting domain comprises, has, or consists of, 26 nucleotides (e.g., 26 consecutive nucleotides) having complementarity with the target domain, e.g., the targeting domain is 26 nucleotides in length.

In an embodiment, the targeting domain comprises, has, or consists of, 16 nucleotides (e.g., 16 consecutive nucleotides) having complementarity with the target domain, e.g., the targeting domain is 16 nucleotides in length; and the proximal and tail domain, when taken together, comprise at least 15, 18, 20, 25, 30, 31, 35, 40, 45, 49, 50, or 53 nucleotides.

In an embodiment, the targeting domain comprises, has, or consists of, 16 nucleotides (e.g., 16 consecutive nucleotides) having complementarity with the target domain, e.g., the targeting domain is 16 nucleotides in length; and there are at least 15, 18, 20, 25, 30, 31, 35, 40, 45, 49, 50, or 53 nucleotides 3' to the last nucleotide of the second complementarity domain.

In an embodiment, the targeting domain comprises, has, or consists of, 16 nucleotides (e.g., 16 consecutive nucleotides) having complementarity with the target domain, e.g., the targeting domain is 16 nucleotides in length; and there are at least 16, 19, 21, 26, 31, 32, 36, 41, 46, 50, 51, or 54 nucleotides 3' to the last nucleotide of the second complementarity domain that is complementary to its corresponding nucleotide of the first complementarity domain.

In an embodiment, the targeting domain has, or consists of, 17 nucleotides (e.g., 17 consecutive nucleotides) having complementarity with the target domain, e.g., the targeting domain is 17 nucleotides in length; and the proximal and tail domain, when taken together, comprise at least 15, 18, 20, 25, 30, 31, 35, 40, 45, 49, 50, or 53 nucleotides.

In an embodiment, the targeting domain has, or consists of, 17 nucleotides (e.g., 17 consecutive nucleotides) having complementarity with the target domain, e.g., the targeting domain is 17 nucleotides in length; and there are at least 15, 18, 20, 25, 30, 31, 35, 40, 45, 49, 50, or 53 nucleotides 3' to the last nucleotide of the second complementarity domain.

In an embodiment, the targeting domain has, or consists of, 17 nucleotides (e.g., 17 consecutive nucleotides) having complementarity with the target domain, e.g., the targeting domain is 17 nucleotides in length; and there are at least 16, 19, 21, 26, 31, 32, 36, 41, 46, 50, 51, or 54 nucleotides 3' to the last nucleotide of the second complementarity domain that is complementary to its corresponding nucleotide of the first complementarity domain.

In an embodiment, the targeting domain has, or consists of, 18 nucleotides (e.g., 18 consecutive nucleotides) having complementarity with the target domain, e.g., the targeting domain is 18 nucleotides in length; and the proximal and tail domain, when taken together, comprise at least 15, 18, 20, 25, 30, 31, 35, 40, 45, 49, 50, or 53 nucleotides.

In an embodiment, the targeting domain has, or consists of, 18 nucleotides (e.g., 18 consecutive nucleotides) having complementarity with the target domain, e.g., the targeting domain is 18 nucleotides in length; and there are at least 15, 18, 20, 25, 30, 31, 35, 40, 45, 49, 50, or 53 nucleotides 3' to the last nucleotide of the second complementarity domain.

In an embodiment, the targeting domain has, or consists of, 18 nucleotides (e.g., 18 consecutive nucleotides) having complementarity with the target domain, e.g., the targeting domain is 18 nucleotides in length; and there are at least 16, 19, 21, 26, 31, 32, 36, 41, 46, 50, 51, or 54 nucleotides 3' to the last nucleotide of the second complementarity domain that is complementary to its corresponding nucleotide of the first complementarity domain.

In an embodiment, the targeting domain comprises, has, or consists of, 19 nucleotides (e.g., 19 consecutive nucleotides) having complementarity with the target domain, e.g., the targeting domain is 19 nucleotides in length; and the proximal and tail domain, when taken together, comprise at least 15, 18, 20, 25, 30, 31, 35, 40, 45, 49, 50, or 53 nucleotides.

In an embodiment, the targeting domain comprises, has, or consists of, 19 nucleotides (e.g., 19 consecutive nucleotides) having complementarity with the target domain, e.g., the targeting domain is 19 nucleotides in length; and there are at least 15, 18, 20, 25, 30, 31, 35, 40, 45, 49, 50, or 53 nucleotides 3' to the last nucleotide of the second complementarity domain.

In an embodiment, the targeting domain comprises, has, or consists of, 19 nucleotides (e.g., 19 consecutive nucleotides) having complementarity with the target domain, e.g., the targeting domain is 19 nucleotides in length; and there are at least 16, 19, 21, 26, 31, 32, 36, 41, 46, 50, 51, or 54 nucleotides 3' to the last nucleotide of the second complementarity domain that is complementary to its corresponding nucleotide of the first complementarity domain.

In an embodiment, the targeting domain comprises, has, or consists of, 20 nucleotides (e.g., 20 consecutive nucleotides) having complementarity with the target domain, e.g., the targeting domain is 20 nucleotides in length; and the proximal and tail domain, when taken together, comprise at least 15, 18, 20, 25, 30, 31, 35, 40, 45, 49, 50, or 53 nucleotides.

In an embodiment, the targeting domain comprises, has, or consists of, 20 nucleotides (e.g., 20 consecutive nucleotides) having complementarity with the target domain, e.g., the targeting domain is 20 nucleotides in length; and there are at least 15, 18, 20, 25, 30, 31, 35, 40, 45, 49, 50, or 53 nucleotides 3' to the last nucleotide of the second complementarity domain.

In an embodiment, the targeting domain comprises, has, or consists of, 20 nucleotides (e.g., 20 consecutive nucleotides) having complementarity with the target domain, e.g., the targeting domain is 20 nucleotides in length; and there are at least 16, 19, 21, 26, 31, 32, 36, 41, 46, 50, 51, or 54 nucleotides 3' to the last nucleotide of the second complementarity domain that is complementary to its corresponding nucleotide of the first complementarity domain.

In an embodiment, the targeting domain comprises, has, or consists of, 21 nucleotides (e.g., 21 consecutive nucleotides) having complementarity with the target domain, e.g., the targeting domain is 21 nucleotides in length; and the proximal and tail domain, when taken together, comprise at least 15, 18, 20, 25, 30, 31, 35, 40, 45, 49, 50, or 53 nucleotides.

In an embodiment, the targeting domain comprises, has, or consists of, 21 nucleotides (e.g., 21 consecutive nucleotides) having complementarity with the target domain, e.g., the targeting domain is 21 nucleotides in length; and there are at least 15, 18, 20, 25, 30, 31, 35, 40, 45, 49, 50, or 53 nucleotides 3' to the last nucleotide of the second complementarity domain.

In an embodiment, the targeting domain comprises, has, or consists of, 21 nucleotides (e.g., 21 consecutive nucleotides) having complementarity with the target domain, e.g., the targeting domain is 21 nucleotides in length; and there are at least 16, 19, 21, 26, 31, 32, 36, 41, 46, 50, 51, or 54 nucleotides 3' to the last nucleotide of the second complementarity domain that is complementary to its corresponding nucleotide of the first complementarity domain.

In an embodiment, the targeting domain comprises, has, or consists of, 22 nucleotides (e.g., 22 consecutive nucleotides) having complementarity with the target domain, e.g., the targeting domain is 22 nucleotides in length; and the proximal and tail domain, when taken together, comprise at least 15, 18, 20, 25, 30, 31, 35, 40, 45, 49, 50, or 53 nucleotides.

In an embodiment, the targeting domain comprises, has, or consists of, 22 nucleotides (e.g., 22 consecutive nucleotides) having complementarity with the target domain, e.g., the targeting domain is 22 nucleotides in length; and there are at least 15, 18, 20, 25, 30, 31, 35, 40, 45, 49, 50, or 53 nucleotides 3' to the last nucleotide of the second complementarity domain.

In an embodiment, the targeting domain comprises, has, or consists of, 22 nucleotides (e.g., 22 consecutive nucleotides) having complementarity with the target domain, e.g., the targeting domain is 22 nucleotides in length; and there are at least 16, 19, 21, 26, 31, 32, 36, 41, 46, 50, 51, or 54 nucleotides 3' to the last nucleotide of the second complementarity domain that is complementary to its corresponding nucleotide of the first complementarity domain.

In an embodiment, the targeting domain comprises, has, or consists of, 23 nucleotides (e.g., 23 consecutive nucleotides) having complementarity with the target domain, e.g., the targeting domain is 23 nucleotides in length; and the proximal and tail domain, when taken together, comprise at least 15, 18, 20, 25, 30, 31, 35, 40, 45, 49, 50, or 53 nucleotides.

In an embodiment, the targeting domain comprises, has, or consists of, 23 nucleotides (e.g., 23 consecutive nucleotides) having complementarity with the target domain, e.g., the targeting domain is 23 nucleotides in length; and there are at least 15, 18, 20, 25, 30, 31, 35, 40, 45, 49, 50, or 53 nucleotides 3' to the last nucleotide of the second complementarity domain.

In an embodiment, the targeting domain comprises, has, or consists of, 23 nucleotides (e.g., 23 consecutive nucleotides) having complementarity with the target domain, e.g., the targeting domain is 23 nucleotides in length; and there are at least 16, 19, 21, 26, 31, 32, 36, 41, 46, 50, 51, or 54 nucleotides 3' to the last nucleotide of the second complementarity domain that is complementary to its corresponding nucleotide of the first complementarity domain.

In an embodiment, the targeting domain comprises, has, or consists of, 24 nucleotides (e.g., 24 consecutive nucleotides) having complementarity with the target domain, e.g., the targeting domain is 24 nucleotides in length; and the proximal and tail domain, when taken together, comprise at least 15, 18, 20, 25, 30, 31, 35, 40, 45, 49, 50, or 53 nucleotides.

In an embodiment, the targeting domain comprises, has, or consists of, 24 nucleotides (e.g., 24 consecutive nucleotides) having complementarity with the target domain, e.g., the targeting domain is 24 nucleotides in length; and there are at least 15, 18, 20, 25, 30, 31, 35, 40, 45, 49, 50, or 53 nucleotides 3' to the last nucleotide of the second complementarity domain.

In an embodiment, the targeting domain comprises, has, or consists of, 24 nucleotides (e.g., 24 consecutive nucleotides) having complementarity with the target domain, e.g., the targeting domain is 24 nucleotides in length; and there are at least 16, 19, 21, 26, 31, 32, 36, 41, 46, 50, 51, or 54 nucleotides 3' to the last nucleotide of the second complementarity domain that is complementary to its corresponding nucleotide of the first complementarity domain.

In an embodiment, the targeting domain comprises, has, or consists of, 25 nucleotides (e.g., 25 consecutive nucleotides) having complementarity with the target domain, e.g., the targeting domain is 25 nucleotides in length; and the proximal and tail domain, when taken together, comprise at least 15, 18, 20, 25, 30, 31, 35, 40, 45, 49, 50, or 53 nucleotides.

In an embodiment, the targeting domain comprises, has, or consists of, 25 nucleotides (e.g., 25 consecutive nucleotides) having complementarity with the target domain, e.g., the targeting domain is 25 nucleotides in length; and there are at least 15, 18, 20, 25, 30, 31, 35, 40, 45, 49, 50, or 53 nucleotides 3' to the last nucleotide of the second complementarity domain.

In an embodiment, the targeting domain comprises, has, or consists of, 25 nucleotides (e.g., 25 consecutive nucleotides) having complementarity with the target domain, e.g., the targeting domain is 25 nucleotides in length; and there are at least 16, 19, 21, 26, 31, 32, 36, 41, 46, 50, 51, or 54 nucleotides 3' to the last nucleotide of the second complementarity domain that is complementary to its corresponding nucleotide of the first complementarity domain.

In an embodiment, the targeting domain comprises, has, or consists of, 26 nucleotides (e.g., 26 consecutive nucleotides) having complementarity with the target domain, e.g., the targeting domain is 26 nucleotides in length; and the proximal and tail domain, when taken together, comprise at least 15, 18, 20, 25, 30, 31, 35, 40, 45, 49, 50, or 53 nucleotides.

In an embodiment, the targeting domain comprises, has, or consists of, 26 nucleotides (e.g., 26 consecutive nucleotides) having complementarity with the target domain, e.g., the targeting domain is 26 nucleotides in length; and there are at least 15, 18, 20, 25, 30, 31, 35, 40, 45, 49, 50, or 53 nucleotides 3' to the last nucleotide of the second complementarity domain.

In an embodiment, the targeting domain comprises, has, or consists of, 26 nucleotides (e.g., 26 consecutive nucleotides) having complementarity with the target domain, e.g., the targeting domain is 26 nucleotides in length; and there are at least 16, 19, 21, 26, 31, 32, 36, 41, 46, 50, 51, or 54 nucleotides 3' to the last nucleotide of the second complementarity domain that is complementary to its corresponding nucleotide of the first complementarity domain.

In another aspect, methods and compositions discussed herein provide methods and compositions for gene editing by using a gRNA molecule which comprises a polyA tail. In one embodiment, a polyA tail of undefined length ranging from 1 to 1000 nucleotide is added enzymatically using a polymerase such as E. coli polyA polymerase (E-PAP). In one embodiment, the polyA tail of a specified length (e.g., 1, 5, 10, 20, 30, 40, 50, 60, 100, or 150 nucleotides) is encoded on a DNA template and transcribed with the gRNA via an RNA polymerase (e.g., T7 RNA polymerase). In one embodiment, a polyA tail of defined length (e.g., 1, 5, 10, 20, 30, 40, 50, 60, 100, or 150 nucleotides) is synthesized as a synthetic oligonucleotide and ligated on the 3' end of the gRNA with either an RNA ligase or a DNA ligase with our without a splinted DNA oligonucleotide complementary to the guide RNA and the polyA oligonucleotide. In one embodiment, the entire gRNA including a defined length of polyA tail is made synthetically, in one or several pieces, and ligated together by either an RNA ligase or a DNA ligase with or without a splinted DNA oligonucleotide.

Additional exemplary gRNAs for use in the present invention are disclosed in International Application WO 2015/048577, the entire contents of which are expressly incorporated herein by reference.

In embodiments, one or more of the gRNA domains (e.g., the targeting domain, first complementarity domain, linking domain, second complementarity domain, proximal domain, or tail domain) has at least 50, 60, 70, 80, 85, 90, or 95% homology with, or differs by no more than 1, 2, 3, 4, 5, or 6 nucleotides from, a corresponding reference domain, e.g., a naturally occurring domain of a bacterial strain disclosed herein.

In an embodiment, one or more of the gRNA domains (e.g., the targeting domain, first complementarity domain, linking domain, second complementarity domain, proximal domain, or tail domain), independently, do not comprise modifications. In an embodiment, one or more of the gRNA domains (e.g., the targeting domain, first complementarity domain, linking domain, second complementarity domain, proximal domain, or tail domain), independently, comprise one or more modifications, e.g., modifications that the render the domain less susceptible to degradation or more bio-compatible, e.g., less immunogenic. By way of example, the backbone of the domain can be modified with a phosphorothioate. In an embodiment a nucleotide of the domain can comprise a 2' modification, e.g., a 2-acetylation or a 2' methylation.

In an embodiment, a method herein involves a second gRNA which is a modular gRNA, e.g., wherein one or more nucleic acid molecules encode a modular gRNA. In other embodiments, the method involves a second gRNA which is a chimeric gRNA. In other embodiments, when the method involves a third or fourth gRNA, the third and fourth gRNA may be a modular gRNA or a chimeric gRNA. When multiple gRNAs are used, any combination of modular or chimeric gRNAs may be used.

Landmarks

Another characteristic of a gRNA molecule is its ability to position a Cas9-mediated cleavage event or break at a desired, e.g., preselected, position on the target nucleic acid. The Cas9-cleavage event can also be characterized as occurring relative to, e.g., within a predefined distance, from a landmark. In an embodiment, one can configure a gRNA such that the gRNA positions a Cas9 molecule so that the Cas9 molecule mediates cleavage, e.g., a double strand or a single strand break, at a preselected position relative to a landmark on a target nucleic acid. In an embodiment, the landmark is the target position, e.g., the nucleotide or one of the nucleotides to be corrected or altered. In an embodiment, the landmark is a position that corresponds to a position in the template nucleic acid, e.g., the 5' or 3' end of the replacement sequence, within the replacement sequence, the replacement position where the replacement position is a single nucleotide, the 5' or 3' of the template nucleic acid, or the 5' or 3' homology arm. In an embodiment, the landmark is an intron/exon boundary, the 5' or 3' end or within a coding region, the 5' or 3' end or within a transcribed region, or the 5' or 3' end or within a repeated element. In an embodiment, the preselected position is at the landmark. In an embodiment, the preselected position is away from the landmark, e.g., within 1, 5, 10, 50, 100, 200, 300, 400, or 500 nucleotides of the landmark, or at least 1, 5, 10, 25, 50 or 100 nucleotides away from the landmark, or 1 to 500, 1 to 400, 1 to 300, 1 to 200, 1 to 100, 10 to 500, 10 to 400, 10 to 300, 10 to 200 or 10 to 100 nucleotides away from the landmark.

II. Methods for Designing gRNAs

Methods for designing gRNAs are described herein, including methods for selecting, designing and validating target domains. Exemplary targeting domains are also provided herein. Targeting Domains discussed herein can be incorporated into the gRNAs described herein.

Methods for selection and validation of target sequences as well as off-target analyses are described, e.g., in Mali et al., 2013 SCIENCE 339(6121): 823-826; Hsu et al. NAT BIOTECHNOL, 31(9): 827-32; Fu et al. (2014) NAT. BIOTECHNOL 32(3): 279-84; Heigwer et al., 2014 NAT METHODS 11(2): 122-3; Bae et al. (2014) BIOINFORMATICS 30(10): 1473-5; Xiao et al. (2014) BIOINFORMATICS 30 (8): 1180-1182. Additional considerations for designing gRNAs are discussed in the section entitled "gRNA Design" in PCT Application WO 2015/048577, the entire contents of which are expressly incorporated herein by reference.

For example, a software tool can be used to optimize the choice of gRNA within a user's target sequence, e.g., to minimize total off-target activity across the genome. Off target activity may be other than cleavage. For each possible gRNA choice using S. pyogenes Cas9, the tool can identify all off-target sequences (preceding either NAG or NGG PAMs) across the genome that contain up to certain number (e.g., 1, 2, 3, 4, 5, 6, 7, 8, 9, or 10) of mismatched base-pairs. The cleavage efficiency at each off-target sequence can be predicted, e.g., using an experimentally-derived weighting scheme. Each possible gRNA is then ranked according to its total predicted off-target cleavage; the top-ranked gRNAs represent those that are likely to have the greatest on-target and the least off-target cleavage. Other functions, e.g., automated reagent design for CRISPR construction, primer design for the on-target Surveyor assay, and primer design for high-throughput detection and quantification of off-target cleavage via next-gen sequencing, can also be included in the tool. Candidate gRNA molecules can be evaluated by art-known methods or as described in Section IV herein.

The targeting domains discussed herein can be incorporated into the gRNAs described herein.

Guide RNAs (gRNAs) for use with S. pyogenes, S. aureus and N. meningitidis Cas9 molecules are identified using a DNA sequence searching algorithm. Guide RNA design is carried out using a custom guide RNA design software based on the public tool cas-offinder (Bae et al. (2014) BIOINFORMATICS 30(10): 1473-5). Said custom guide RNA design software scores guides after calculating their genome-wide off-target propensity. Typically matches ranging from perfect matches to 7 mismatches are considered for guides ranging in length from 17 to 24. Once the off-target sites are computationally determined, an aggregate score is calculated for each guide and summarized in a tabular output using a web-interface. In addition to identifying potential gRNA sites adjacent to PAM sequences, the software also identifies all PAM adjacent sequences that differ by 1, 2, 3 or more nucleotides from the selected gRNA sites. Genomic DNA sequence for each gene was obtained from the UCSC Genome browser and sequences were screened for repeat elements using the publically available RepeatMasker program. RepeatMasker searches input DNA sequences for repeated elements and regions of low complexity. The output is a detailed annotation of the repeats present in a given query sequence.

Following identification, gRNAs are ranked into tiers based on their distance to the target site, their orthogonality and presence of a 5' G (based on identification of close matches in the human genome containing a relevant PAM (e.g., in the case of S. pyogenes, a NGG PAM, in the case of S. aureus, a NNGRRT or NNGRRV PAM, and in the case of N. meningitidis, a NNNNGATT or NNNNGCTT PAM). Orthogonality refers to the number of sequences in the human genome that contain a minimum number of mismatches to the target sequence. A "high level of orthogonality" or "good orthogonality" may, for example, refer to 20-mer gRNAs that have no identical sequences in the human genome besides the intended target, nor any sequences that contain one or two mismatches in the target sequence. Targeting domains with good orthogonality are selected to minimize off-target DNA cleavage.

gRNAs are identified for both single-gRNA nuclease cleavage and for a dual-gRNA paired "nickase" strategy. Criteria for selecting gRNAs and the determination for which gRNAs can be used for the dual-gRNA paired "nickase" strategy is based on two considerations: gRNA pairs should be oriented on the DNA such that PAMs are facing out and cutting with the D10A Cas9 nickase will result in 5' overhangs.

An assumption that cleaving with dual nickase pairs will result in deletion of the entire intervening sequence at a reasonable frequency. However, cleaving with dual nickase pairs can also result in indel mutations at the site of only one of the gRNAs. Candidate pair members can be tested for how efficiently they remove the entire sequence versus causing indel mutations at the site of one gRNA.

The targeting domains discussed herein can be incorporated into the gRNAs described herein.

In an embodiment, two or more (e.g., three or four) gRNA molecules are used with one Cas9 molecule. In another embodiment, when two or more (e.g., three or four) gRNAs are used with two or more Cas9 molecules, at least one Cas9 molecule is from a different species than the other Cas9 molecule(s). For example, when two gRNA molecules are used with two Cas9 molecules, one Cas9 molecule can be from one species and the other Cas9 molecule can be from a different species. Both Cas9 species are used to generate a single or double-strand break, as desired.

In some embodiments, the targeting domains described herein are used with a Cas9 nickase molecule to generate a single strand break.

In some embodiments, the targeting domains described herein are used with a Cas9 nuclease molecule to generate a double strand break.

When two gRNAs designed for use to target two Cas9 molecules, one Cas9 can be one species, the second Cas9 can be from a different species. Both Cas9 species are used to generate a single or double-strand break, as desired.

It is contemplated herein that any upstream gRNA described herein may be paired with any downstream gRNA described herein. When an upstream gRNA designed for use with one species of Cas9 is paired with a downstream gRNA designed for use from a different species of Cas9, both Cas9 species are used to generate a single or double-strand break, as desired.

In an embodiment, the targeting domain of a gRNA molecule is configured to avoid unwanted target chromosome elements, such as repeat elements, e.g., Alu elements, in the target domain. The gRNA molecule may be a first, second, third and/or fourth gRNA molecule.

Strategies to Identify HDR-Enhancing gRNAs to Alter a Gene

In some embodiments, the methods described herein comprise altering (e.g., modifying, e.g., by activating or repressing) the expression of a gene (e.g., a gene encoding a protein involved in one or more DNA repair pathways). In some embodiments, the expression of the gene is altered using a HDR-enhancing gRNA. In some embodiments, the methods described herein provide an alteration of (e.g., by repressing) the expression of a gene that does not comprise nucleotide insertion or deletion of the gene. In some embodiments, this type of alteration is also referred to as "knocking down" the expression of the gene.

In other embodiments, the altered expression of a gene, e.g., is mediated by a CRISPR/Cas system comprising a Cas9 molecule (e.g., an eaCas9 molecule or an eiCas9 molecule) and an HDR-enhancing gRNA in order to alter transcription (e.g., to block, reduce, increase transcription, or decrease transcription) of the gene. In some embodiments, where an eiCas9 molecule is used, transcription of the gene is altered temporarily or transiently. In one embodiment, the HDR-enhancing gRNA targets 53BP1, Rift, PTIP, KU 70, KU 80, XRCC4, XLF, Artemis, BRCA2, BRCA1, CtIP, EXo1, DNA2, MRN complex, MRE11, Rad50, NbsI, Rad51, XRCC1, Ligase I, Ligase III, Pol Theta, Fbh1, RTEL, PARI, Rap80, Rad52, ERCC1, XPF, XRCC1, Msh2, Msh3, Msh6, M1h1, Pms2, or KDM4A/JMJD2A. In another embodiment, the gene may be selected from the group consisting of TP53BP1, RIF1, PAXIP1, XRCC6, XRCC5, PRKDC, LIG4, XRCC4, NHEJ1, DCLRE1C, BRCA2, RAD51, XRCC1, LIG1, LIG3, POLQ, FBXO18, RTEL1, PARPBP, UIMC1, RAD52, ERCC1, ERCC4, PARP1, BRCA1, RBBP8, EXO1, DNA2, MRE11A, RAD50, NBN, MSH2, MSH3, MSH6, M1H1, PMS2, EZH2, KDM4A/ JMJD2A, and CKD1.

In another embodiment, the altered expression of a gene is mediated by a CRISPR/Cas system comprising a Cas9-fusion molecule (e.g., an eiCas9 fusion molecule, e.g., an eiCas9 molecule fused to a transcription repressor domain, a transcription activator domain, or a chromatin modifying domain) and an HDR-enhancing gRNA to alter transcription (e.g., to block, reduce, increase transcription, or decrease transcription) of the gene. In some embodiments, where an eiCas9 molecule is used, transcription of the gene is altered temporarily or transiently. In one embodiment, the HDR-enhancing gRNA targets 53BP1, Rif1, PTIP, KU 70, KU 80, XRCC4, XLF, Artemis, BRCA2, BRCA1, CtIP, EXo1, DNA2, MRN complex, MRE11, Rad50, NbsI, Rad51, XRCC1, Ligase I, Ligase III, Pol Theta, Fbh1, RTEL, PARI, Rap80, Rad52, ERCC1, XPF, XRCC1, Msh2, Msh3, Msh6, M1h1, Pms2, or KDM4A/JMJD2A. In one embodiment, the target gene may be selected from the group consisting of TP53BP1, RIF1, PAXIP1, XRCC6, XRCC5, PRKDC, LIG4, XRCC4, NHEJ1, DCLRE1C, BRCA2, RAD51, XRCC1, LIG1, LIG3, POLQ, FBXO18, RTEL1, PARPBP, UIMC1, RAD52, ERCC1, ERCC4, PARP1, BRCA1, RBBP8, EXO1, DNA2, MRE11A, RAD50, NBN, MSH2, MSH3, MSH6, M1H1, PMS2, EZH2, KDM4A/JMJD2A, and CKD1.

A transcriptional activator or a transcriptional repressor can be linked, or fused, to any of the Cas9 molecules described herein either covalently or non-covalently. The transcriptional activator or a transcriptional repressor can be linked, covalently or non-covalently, to the N terminus or the C terminus of the Cas9 molecule. The transcriptional activator or a transcriptional repressor can be linked to a residue other than the N or C terminal residue of the Cas9 molecule, e.g., to an internal residue of the Cas9 molecule. In an embodiment the linkage is other than a peptide linkage between amino acid residues of the Cas9/transcriptional activator or a transcriptional repressor, e.g., the linkage is a covalent linkage through a side chain of an amino acid of the Cas 9 molecule and/or the transcriptional activator or a transcriptional repressor. By way of example, the linkage can be a linkage to the terminal N of the side chain of a lysine, e.g., an internal lysine residue, e.g., an inernal lysine residue from any of the Cas 9 domains described herein. In an embodiment the transcriptional activator or a transcriptional repressor is linked, postranslationally, to a Cas 9 molecule. The transcriptional activator or a transcriptional repressor is linked to the Cas9 molecule such that proper folding and function of the Cas9 molecule and the transcriptional activator or a transcriptional repressor is maintained. In an embodiment the linkage is a peptide linkage, e.g., as in a fusion protein.

In an embodiment, a linker, e.g., a linker described herein, is disposed between the Cas9 molecule and the transcriptional activator or a transcriptional repressor. The linker can be disposed at the N terminus of the transcriptional activator or a transcriptional repressor. The linker can be disposed at the C terminus of the transcriptional activator or a transcriptional repressor. In an embodiment, a linker is disposed at the N terminus and the C terminus of the transcriptional activator or a transcriptional repressor. In an embodiment, a linker is disposed between an amino acid residue of the Cas 9 molecule and the transcriptional activator or a transcriptional repressor.

The linker may be a short peptide sequence. Exemplary linkers suitable for use to link a transcriptional activator or a transcriptional repressor to a Cas9 molecule are disclosed herein. In an embodiment, a linker is not used and the Cas9 molecule and the transcriptional activator or a transcriptional repressor are directly linked to each other by a covalent bond, e.g., a peptide bond. In alternative embodiments, the Cas9 molecule and the transcriptional activator or a transcriptional repressor are linked by a covalent bond that is not a peptide bond, e.g., by chemical conjugation.

In an embodiment, the Cas9/transcriptional activator or a transcriptional repressor is a fusion protein, where transcriptional activator or a transcriptional repressor is covalently linked to the Cas9 molecule by a peptide bond. The N terminus or C terminus of the transcriptional activator or a transcriptional repressor can be linked to the N terminus, e.g., the N-terminal residue, or the C terminus, e.g., the C-terminal residue of the Cas9 molecule. In another embodiment, the transcriptional activator or a transcriptional repressor is linked to a residue that is not the N terminal residue or the C terminal residue of the Cas9 molecule, e.g., the transcriptional activator or a transcriptional repressor is linked to an internal residue of the Cas9 molecule. In an embodiment, the transcriptional activator or a transcriptional repressor is inserted to the sequence of a Cas 9 molecule. In an embodiment, the N-terminal residue of the transcriptional activator or a transcriptional repressor is linked to an internal residue of the Cas9 molecule and the C-terminal residue of the transcriptional activator or a transcriptional repressor is linked to an internal residue of the Cas9 molecule.

When the transcriptional activator or a transcriptional repressor is linked to an internal residue of the Cas9 molecule as a fusion protein, the transcriptional activator or a transcriptional repressor is disposed between sequences of the Cas9 molecule, such that the primary structure of the Cas9 fusion protein is organized as follows: Cas9N-L1-transcriptional activator or transcriptional repressor-L2-Cas9C, wherein Cas9N represents an N terminal portion of the sequence of the Cas9 molecule, transcriptional activator or transcriptional repressor represents the transcriptional activator or transcriptional repressor, Cas9C represents a C terminal portion of the Cas9 molecule, L1 is an optional linker, and L2 is an optional linker. A Cas9 fusion protein can comprise L1, L2, or both L1 and L2. L1 and L2 can be the same, or different, e.g., they can differ in length, or in amino acid composition or sequence. In an embodiment the transcriptional activator or transcriptional repressor (with or without L1 and/or L2) can be disposed between two amino acid residues that are adjacent one another in the Cas 9 molecule. In an embodiment the transcriptional activator or transcriptional repressor (with or without L1 and/or L2) can be substituted for one or more amino acid residues of the Cas 9 molecule, e.g., a region of Cas 9 molecule sequence can be deleted and replaced with the transcriptional activator or transcriptional repressor (with or without L1 and/or L2). In an embodiment, a Cas9 fusion protein, comprises a plurality of, e.g., 2, or 3, transcriptional activators or transcriptional repressors (with or without L1 and/or L2).

In an embodiment, a first linker is disposed between Cas9N and the N-terminus of the transcriptional activator or transcriptional repressor and a second linker is disposed between the C-terminus of the transcriptional activator or transcriptional repressor and Cas9C. The linkers disposed between an transcriptional activator or transcriptional repressor and a Cas9, or a portion of a Cas9 molecule, may be selected for specific length and/or flexibility to allow the primary structure of the transcriptional activator or transcriptional repressor and the Cas9 molecule to properly fold such that the transcriptional activator or transcriptional repressor and the Cas9 molecule exhibit functional activity.

In an embodiment, the transcriptional activator or transcriptional repressor is disposed in a region of the Cas9 molecule that is not highly conserved and/or is dispensable for Cas9 activity. For example, the transcriptional activator or transcriptional repressor may be disposed in a REC domain, or in place of all or part of a REC domain. For example, the transcriptional activator or transcriptional repressor (with or without L1 and/or L2) disposed in a REC deletion, e.g., the $REC_2$ deletion, the $REC1_{CT}$ deletion, or the $REC1_{SUB}$ deletion, as these regions are known for being dispensable for Cas9 activity, and are spatially distant from the regions that mediate Cas9 activity. In this embodiment, when the Cas9/transcriptional activator or transcriptional repressor fusion protein is folded, the regions of the Cas9 molecule, including the regions physically separated by the transcriptional activator or transcriptional repressor sequence in the primary structure, are able to fold such that the Cas9 molecule comprises functional Cas9 activity. In addition, the transcriptional activator or transcriptional repressor is linked to the Cas9 molecule sequences such that the transcriptional activator or transcriptional repressor can also fold such that the transcriptional activator or transcriptional repressor comprises functional transcriptional activator or transcriptional repressor activity.

A fusion protein comprising a Cas9 molecule and a transcriptional activator or transcriptional repressor is generated using standard recombinant DNA techniques known in the art, such as by constructing a recombinant nucleic acid molecule that comprises a nucleic acid sequence encoding the Cas9 molecule and a nucleic acid sequence encoding the transcriptional activator or transcriptional repressor in a configuration such that expression of the recombinant nucleic acid results in production of the Cas9/transcriptional activator or transcriptional repressor fusion protein, e.g., the nucleic acid sequence(s) encoding the Cas9 molecule is in frame with the nucleic acid sequence encoding the transcriptional activator or transcriptional repressor.

In some embodiments, the knockdown of a gene is mediated by a CRISPR/Cas system comprising a Cas9-fusion molecule (e.g., an eiCas9 molecule fused to a transcription repressor domain or a chromatin modifying domain) and an HDR-enhancing gRNA to decrease transcription (e.g., to block, or reduce transcription) of the gene. In some embodiments, the knockdown of a gene is mediated by a CRISPR/Cas system comprising an eiCas9 molecule fused to a transcription repressor domain and an HDR-enhancing gRNA to decrease transcription (e.g., to block, or reduce transcription) of the gene. In some embodiments, where an eiCas9 molecule is used, transcription of the gene is altered temporarily or transiently. In some embodiments, this approach results in a reduction, decrease, repression, or elimination of the expression of the gene (e.g., by inhibiting transcription) of the gene. In some embodiments, the transcription of the target gene is reduced by at least about 10%, at least about 20%, at least about 30%, at least about 40%, at least about 50%, at least about 60%, at least about 70%, at least about 80%, at least about 90%, or greater than 90%, as compared to the level of transcription of the target gene in the absence of the HDR-enhancing gRNA that targets the gene.

In one embodiment, the transcription repressor is KRAB, Mad mSIN3 interaction domain, the ERF repressor domain, a histone lysine methyltransferase (KMT), a histone lysine demethylase (KDM), a histone lysine deacetylase, a DNA methylase, a boundary element, or a periphery recruitment element. In one embodiment, the KMT is SUV39H1, SUV39H2, G9A, Pr-SET7/8, SUV4-10H1, PR-set7, Suv4-20, Set9, EZH2, RIZ1, LSD1/BHC110, SpLsd1/Swm1/Saf110, Su(var)3-3, JMJD2A/JHDM3A, JMJD2B, JMJD2C/GASC1, JMJD2D, Rph1, JARID1A/RBP2, JARID1B/PLU-1, JARID1C/SMCX, JARID1D/SMCY, Lid, Jhn2, or Jmj2. In one embodiment, the histone lysine deacetylase is HDAC1, HDAC2, HDAC3, HDAC8, Rpd3, Hos1, Cir6, HDAC4, HDAC5, HDAC7, HDAC9, Hda1, Cir3, SIRT1, SIRT2, Sir2, Hst1, Hst2, Hst3, HSt4, or HDAC11. In one embodiment, the DNA methylase is Dam, Dcm, M. SssI, DNMT1, DNMT3a/DNMT3b, METI, DRM3, ZMET2, CMT1, or CMT2. In one embodiment, the boundary element is CTCF. In one embodiment, the periphery recruitment element is Lamin A or Lamin B.

In some embodiments, the altered expression of a gene is mediated by a CRISPR/Cas system comprising a Cas9-fusion molecule (e.g., an eiCas9 molecule fused to a transcription activator domain or a chromatin modifying domain) and an HDR-enhancing gRNA to increase transcription of the gene. In some embodiments, increased expression of a gene is mediated by a CRISPR/Cas system comprising a an eiCas9 molecule fused to a transcription activator domain and an HDR-enhancing gRNA to increase transcription of the gene. In some embodiments, where an eiCas9 molecule is used, transcription of the gene is altered temporarily or transiently. In some embodiments, this approach results in increased expression of the gene (e.g., by increasing transcription) of the gene. In some embodiments, the transcription of the target gene is increased by at least about 10%, at least about 20%, at least about 30%, at least about 40%, at least about 50%, at least about 60%, at least about 70%, at least about 80%, at least about 90%, at least about 1.1 fold, at least about 1.2 fold, at least about 1.3 fold, at least about 1.4 fold, at least about 1.5 fold, at least about 1.6 fold, at least about 1.7 fold, at least about 1.8 fold, at least about 1.9 fold, at least about 2 fold, at least about 2.5 fold, at least about 3 fold, at least about 3.5 fold, at least about 4 fold, at least about 4.5 fold, at least about 5 fold, at least about 6 fold, at least about 7 fold, at least about 8 fold, at least about 9 fold, at least about 10 fold, at least about 12 fold, at least about 15 fold, at least about 18 fold, or at least about 20-fold, as compared to the level of transcription of the target gene in the absence of the HDR-enhancing gRNA that targets the gene.

In one embodiment, the transcription activator is GAL4, VP16, VP64, a p65 subdomain (NFkB), a histone lysine methyltransferase (KMT), a histone lysine demethylate (KDM), a histone lysine acetyltransferase (KAT), a DNA demethylase, or a protein docking element. In one embodiment, the KMT is hSET1A, hSET1B, MLL1, MLL2, MLL3, MLL4, MLL5, ASH1, Trx, Trr, Ash1, SYMD2, NSD1, or DOT1. In one embodiment, the KDM is LSD1/BHC110, JHDM2a/b, UTX, or JMJD3. In one embodiment, the KAT is hGCN4, PCAF, dGCN5/PCAF, Gcn5, CBP, p300, dCBP/ NEJ, TAF1, TIP60/PLIP, MOZ/MYST3, MORF/MYST4, Mst2, Sas3, CG1894, HBO1/MYST2, CHM, Mst2, HMOF/ MYST1, dMOF, Sas2, Mst2, SRC1, ACTR, P160, or CLOCK. In one embodiment, the DNA demethylase is AID, TET1, DME, DML1, DML2, ROS1. In one embodiment, the protein docking element is FKBP/FRB (S. pombe) or Pil1/Abyl (E. coli).

In some embodiments, a non-coding region (e.g., an enhancer region, a promoter region a 5' UTR, 3' UTR, and a polyadenylation signal) of a gene is targeted to alter the expression of the gene. In some embodiments, a transcriptional regulatory region, e.g., a promoter region (e.g., a promoter region that controls the transcription of the gene) is targeted to alter (e.g., by knocking-down) the expression of the gene. In certain embodiments, one or more gRNA molecules comprise a targeting domain configured to target an eiCas9 molecule or an eiCas9 fusion protein sufficiently close to the transcriptional regulatory region, e.g., a promoter region (e.g., a promoter region that controls the transcription of the gene) to reduce, decrease or repress expression of the gene.

In some embodiments, the methods described herein provide an alteration of the expression of a gene that does not comprise nucleotide insertion or deletion of the gene. In some embodiments, this approach results in an increase in the expression of the gene. In some embodiments, the increase in expression of a gene is mediated by a CRISPR/ Cas system comprising a Cas9 molecule (e.g., an eiCas9 molecule) or a Cas9-fusion molecule (e.g., an eiCas9 fusion molecule (e.g., an eiCas9 molecule fused to a transcription activator domain or a chromatin modifying domain) to alter transcription (e.g., to increase transcription) of the gene. In some embodiments, a non-coding region (e.g., an enhancer region, a promoter region a 5' UTR, 3' UTR, and a poly-adenylation signal) of a gene is targeted to alter the expression (e.g., increase expression) of the gene. In some embodiments, a transcriptional regulatory region, e.g., a promoter region (e.g., a promoter region that controls the transcription of the gene) is targeted to alter (e.g., by increasing) the expression of the gene. In certain embodiments, one or more gRNA molecules comprise a targeting domain configured to target an eiCas9 molecule or an eiCas9 fusion protein sufficiently close to the transcriptional regulatory region, e.g., a promoter region (e.g., a promoter region that controls the transcription of the gene) to increase expression of the gene.

As an example, three strategies were utilized to identify gRNAs for use with S. pyogenes, S. aureus and N. meningitidis Cas9 molecules. In some embodiments, the identified gRNA may be used to alter (e.g., activate or repress) a gene listed in Table I.

As an example, three strategies were utilized to identify gRNAs for use with S. pyogenes, S. aureus and N. meningitidis Cas9 molecules.

TABLE II.1

Exemplary Genes Targets For Altered Gene Expression Using an HDR-Enhancing gRNA

| RefSeq Target Name | Gene ID |
| --- | --- |
| TP53BP1 | 7158 |
| RIF1 | 55183 |
| PAXIP1 | 22976 |
| XRCC6 | 2547 |
| XRCC5 | 7520 |
| PRKDC | 5591 |
| LIG4 | 3981 |
| XRCC4 | 7518 |
| NHEJ1 | 79840 |
| DCLRE1C | 64421 |
| BRCA2 | 675 |
| RAD51 | 5888 |
| XRCC1 | 7515 |
| LIG1 | 3978 |
| LIG3 | 3980 |
| POLQ | 10721 |
| FBXO18 | 84893 |
| RTEL1 | 51750 |
| PARPBP | 55010 |
| UIMC1 | 51720 |
| RAD52 | 5893 |
| ERCC1 | 2067 |
| ERCC4 | 2072 |
| PARP1 | 142 |
| BRCA1 | 672 |
| RBBP8 | 5932 |
| EXO1 | 9156 |
| DNA2 | 1763 |
| MRE11A | 4361 |
| RAD50 | 10111 |
| NBN | 4683 |
| MSH2 | 4436 |
| MSH3 | 4437 |
| MSH6 | 2956 |
| MlH1 | 4292 |
| PMS2 | 5395 |
| EZH2 | 2146 |
| KDM4A/JMJD2A | 9682 |
| CDK1 | 983 |

As an example, HDR-enhancing gRNAs for use with S. pyogenes, and S. aureus Cas9 molecules were identified using a DNA sequence searching algorithm. HDR-enhancing guide RNA design was carried out using a custom guide RNA design software based on the public tool cas-offinder (Bae et al. (2014)). Said custom guide RNA design software scores guides after calculating their genomewide off-target propensity. Typically matches ranging from perfect matches to 7 mismatches were considered for guides ranging in length from 17 to 24. Once the off-target sites were computationally determined, an aggregate score was calculated for each guide and summarized in a tabular output using a web-interface. In addition to identifying potential gRNA sites adjacent to PAM sequences, the software also identifies all PAM adjacent sequences that differ by 1, 2, 3 or more nucleotides from the selected gRNA sites. Genomic DNA sequence for each gene was obtained from the UCSC Genome browser and sequences were screened for repeat elements using the publically available RepeatMasker program. RepeatMasker searches input DNA sequences for repeated elements and regions of low complexity. The output is a detailed annotation of the repeats present in a given query sequence.

Following identification, HDR-enhancing gRNAs were ranked into tiers based on their distance to the target site, their orthogonality and presence of a 5' G (based on identification of close matches in the human genome containing a relevant PAM (e.g., in the case of S. pyogenes, a NGG PAM, in the case of S. aureus, a NNGRRT or NNGRRV PAM, and in the case of N. meningitidis, a NNNNGATT or NNNNGCTT PAM). Orthogonality refers to the number of sequences in the human genome that contain a minimum number of mismatches to the target sequence. A "high level of orthogonality" or "good orthogonality" may, for example, refer to 20-mer HDR-enhancing gRNAs that have no identical sequences in the human genome besides the intended target, nor any sequences that contain one or two mismatches in the target sequence. Targeting domains with good orthogonality are selected to minimize off-target DNA cleavage.

For example, for S. pyogenes and N. meningitidis targets, 17-mer, or 20-mer HDR-enhancing gRNAs were designed. As another example, for S. aureus targets, 18-mer, 19-mer, 20-mer, 21-mer, 22-mer, 23-mer and 24-mer HDR-enhancing gRNAs were designed. In some embodiments, the targeting domains, disclosed herein, may comprise the 17-mer described in Tables II.1A, II.1B, II.2A, II.2B, II.3A, II.3B, II.4A, II.4B, II.5A, II.5B, II.6A, II.6B, II.7A, II.7B, II.8A, II.8B, II.9A, II.9B, II.10A, II.10B, II.11A, II.11B, II.12A, II.12B, II.13A, II.13B, II.14A, II.14B, II.15A, II.15B, II.16A, II.16B, II.17A, II.17B, II.18A, II.18B, II.19A, II.19B, II.20A, II.20B, II.21A, II.21B, II.22A, II.22B, II.23A, II.23B, II.24A, II.24B, II.25A, II.25B, II.26A, II.26B, II.27A, II.27B, II.28A, II.28B, II.29A, II.29B, II.30A, II.30B, II.31A, II.31B, II.32A, II.32B, II.33A, II.33B, II.34A, II.34B, II.35A, II.35B, II.36A, II.36B, II.37A, II.37B, II.38A, II.38B, II.39A, II.39B, II.40A, II.40B, II.41A, II.41B, II.42A, II.42B, II.43A, II.43B, II.44A, II.44B, II.45A, II.45B, II.46A, II.46B, II.47A, II.47B, II.48A, II.48B, II.49A, II.49B, II.50A, II.50B, II.51A, II.51B, II.52A, II.52B, II.53A, II.53B, II.54A, II.54B, II.55A, II.55B, II.56A, II.56B, II.57A, II.57B, II.58A, II.58B, II.59A, II.59B, II.60A, II.60B, II.61A, II.61B, II.62A, II.62B, II.63A, II.63B, II.64A, II.64B, II.65A, II.65B, II.66, II.67A, II.67B, II.68A, II.68B, II.69A, II.69B, II.70A, II.70B, II.71A, II.71B, II.72A, II.72B, II.73A, II.73B, II.74A, II.74B, II.75A, II.75B, II.76A, II.76B, II.77A, II.77B, II.78A, or II.78B, e.g., the targeting domains of 18 or more nucleotides may comprise the 17-mer HDR-enhancing gRNAs described in Tables II.1A, II.1B, II.2A, II.2B, II.3A, II.3B, II.4A, II.4B, II.5A, II.5B, II.6A, II.6B, II.7A, II.7B, II.8A, II.8B, II.9A, II.9B, II.10A, II.10B, II.11A, II.11B, II.12A, II.12B, II.13A, II.13B, II.14A, II.14B, II.15A, II.15B, II.16A, II.16B, II.17A, II.17B, II.18A, II.18B, II.19A, II.19B, II.20A, II.20B, II.21A, II.21B, II.22A, II.22B, II.23A, II.23B, II.24A, II.24B, II.25A, II.25B, II.26A, II.26B, II.27A, II.27B, II.28A, II.28B, II.29A, II.29B, II.30A, II.30B, II.31A, II.31B, II.32A, II.32B, II.33A, II.33B, II.34A, II.34B, II.35A, II.35B, II.36A, II.36B, II.37A, II.37B, II.38A, II.38B, II.39A, II.39B, II.40A, II.40B, II.41A, II.41B, II.42A, II.42B, II.43A, II.43B, II.44A, II.44B, II.45A, II.45B, II.46A, II.46B, II.47A, II.47B, II.48A, II.48B, II.49A, II.49B, II.50A, II.50B, II.51A, II.51B, II.52A, II.52B, II.53A, II.53B, II.54A, II.54B, II.55A, II.55B, II.56A, II.56B, II.57A, II.57B, II.58A, II.58B, II.59A, II.59B, II.60A, II.60B, II.61A, II.61B, II.62A, II.62B, II.63A, II.63B, II.64A, II.64B, II.65A, II.65B, II.66, II.67A, II.67B, II.68A, II.68B, II.69A, II.69B, II.70A, II.70B, II.71A, II.71B, II.72A, II.72B, II.73A, II.73B, II.74A, II.74B, II.75A, II.75B, II.76A, II.76B, II.77A, II.77B, II.78A, or II.78B. In some embodiments, the targeting domains, disclosed herein, may comprises the 18-mer described in Tables II.1A, II.1B, II.2A, II.2B, II.3A, II.3B, II.4A, II.4B, II.5A, II.5B, II.6A, II.6B, II.7A, II.7B, II.8A, II.8B, II.9A, II.9B, II.10A, II.10B, II.11A, II.11B, II.12A, II.12B, II.13A, II.13B, II.14A, II.14B, II.15A, II.15B, II.16A, II.16B, II.17A, II.17B, II.18A, II.18B, II.19A, II.19B, II.20A, II.20B, II.21A, II.21B, II.22A, II.22B, II.23A, II.23B, II.24A, II.24B, II.25A, II.25B, II.26A, II.26B, II.27A, II.27B, II.28A, II.28B, II.29A, II.29B, II.30A, II.30B, II.31A, II.31B, II.32A, II.32B, II.33A, II.33B, II.34A, II.34B, II.35A, II.35B, II.36A, II.36B, II.37A, II.37B, II.38A, II.38B, II.39A, II.39B, II.40A, II.40B, II.41A, II.41B, II.42A, II.42B, II.43A, II.43B, II.44A, II.44B, II.45A, II.45B, II.46A, II.46B, II.47A, II.47B, II.48A, II.48B, II.49A, II.49B, II.50A, II.50B, II.51A, II.51B, II.52A, II.52B, II.53A, II.53B, II.54A, II.54B, II.55A, II.55B, II.56A, II.56B, II.57A, II.57B, II.58A, II.58B, II.59A, II.59B, II.60A, II.60B, II.61A, II.61B, II.62A, II.62B, II.63A, II.63B, II.64A, II.64B, II.65A, II.65B, II.66, II.67A, II.67B, II.68A, II.68B, II.69A, II.69B, II.70A, II.70B, II.71A, II.71B, II.72A, II.72B, II.73A, II.73B, II.74A, II.74B, II.75A, II.75B, II.76A, II.76B, II.77A, II.77B, II.78A, or II.78B. In some embodiments, the targeting domains, disclosed herein, may comprises the 19-mer described in Tables II.1A, II.1B, II.2A, II.2B, II.3A, II.3B, II.4A, II.4B, II.5A, II.5B, II.6A, II.6B, II.7A, II.7B, II.8A, II.8B, II.9A, II.9B, II.10A, II.10B, II.11A, II.11B, II.12A, II.12B, II.13A, II.13B, II.14A, II.14B, II.15A, II.15B, II.16A, II.16B, II.17A, II.17B, II.18A, II.18B, II.19A, II.19B, II.20A, II.20B, II.21A, II.21B, II.22A, II.22B, II.23A, II.23B, II.24A, II.24B, II.25A, II.25B, II.26A, II.26B, II.27A, II.27B, II.28A, II.28B, II.29A, II.29B, II.30A, II.30B, II.31A, II.31B, II.32A, II.32B, II.33A, II.33B, II.34A, II.34B, II.35A, II.35B, II.36A, II.36B, II.37A, II.37B, II.38A, II.38B, II.39A, II.39B, II.40A, II.40B, II.41A, II.41B, II.42A, II.42B, II.43A, II.43B, II.44A, II.44B, II.45A, II.45B, II.46A, II.46B, II.47A, II.47B, II.48A, II.48B, II.49A, II.49B, II.50A, II.50B, II.51A, II.51B, II.52A, II.52B, II.53A, II.53B, II.54A, II.54B, II.55A, II.55B, II.56A, II.56B, II.57A, II.57B, II.58A, II.58B, II.59A, II.59B, II.60A, II.60B, II.61A, II.61B, II.62A, II.62B, II.63A, II.63B, II.64A, II.64B, II.65A, II.65B, II.66, II.67A, II.67B, II.68A, II.68B, II.69A, II.69B, II.70A, II.70B, II.71A, II.71B, II.72A, II.72B, II.73A, II.73B, II.74A, II.74B, II.75A, II.75B, II.76A, II.76B, II.77A, II.77B, II.78A, or II.78B, e.g., the targeting domains of 20 or more nucleotides may comprise the 19-mer HDR-enhancing gRNAs described in Tables II.1A, II.1B, II.2A, II.2B, II.3A, II.3B, II.4A, II.4B, II.5A, II.5B, II.6A, II.6B, II.7A, II.7B, II.8A, II.8B, II.9A, II.9B, II.10A, II.10B, II.11A, II.11B, II.12A, II.12B, II.13A, II.13B, II.14A, II.14B, II.15A, II.15B, II.16A, II.16B, II.17A, II.17B, II.18A, II.18B, II.19A, II.19B, II.20A, II.20B, II.21A, II.21B, II.22A, II.22B, II.23A, II.23B, II.24A, II.24B, II.25A, II.25B, II.26A, II.26B, II.27A, II.27B, II.28A, II.28B, II.29A, II.29B, II.30A, II.30B, II.31A, II.31B, II.32A, II.32B, II.33A, II.33B, II.34A, II.34B, II.35A, II.35B, II.36A, II.36B, II.37A, II.37B, II.38A, II.38B, II.39A, II.39B, II.40A, II.40B, II.41A, II.41B, II.42A, II.42B, II.43A, II.43B, II.44A, II.44B, II.45A, II.45B, II.46A, II.46B, II.47A, II.47B, II.48A, II.48B, II.49A, II.49B, II.50A, II.50B, II.51A, II.51B, II.52A, II.52B, II.53A, II.53B, II.54A, II.54B, II.55A, II.55B, II.56A, II.56B, II.57A, II.57B, II.58A, II.58B, II.59A, II.59B, II.60A, II.60B, II.61A, II.61B, II.62A, II.62B, II.63A, II.63B, II.64A, II.64B, II.65A, II.65B, II.66, II.67A, II.67B, II.68A, II.68B, II.69A, II.69B, II.70A, II.70B, II.71A, II.71B, II.72A, II.72B, II.73A, II.73B, II.74A, II.74B, II.75A, II.75B, II.76A, II.76B, II.77A, II.77B, II.78A, or II.78B. In some embodiments, the targeting domains, disclosed herein, may comprises the 20-mer gRNAs described in Tables II.1A, II.1B, II.2A, II.2B, II.3A, II.3B, II.4A, II.4B, II.5A, II.5B, II.6A, II.6B, II.7A, II.7B, II.8A, II.8B, II.9A, II.9B, II.10A, II.10B, II.11A, II.11B, II.12A, II.12B, II.13A, II.13B, II.14A, II.14B, II.15A, II.15B, II.16A, II.16B, II.17A, II.17B, II.18A, II.18B, II.19A, II.19B, II.20A, II.20B, II.21A, II.21B, II.22A, II.22B, II.23A, II.23B, II.24A, II.24B, II.25A, II.25B, II.26A, II.26B, II.27A, II.27B, II.28A, II.28B, II.29A, II.29B, II.30A, II.30B, II.31A, II.31B, II.32A, II.32B, II.33A, II.33B, II.34A, II.34B, II.35A, II.35B, II.36A, II.36B, II.37A, II.37B, II.38A, II.38B, II.39A, II.39B, II.40A, II.40B, II.41A, II.41B, II.42A, II.42B, II.43A, II.43B, II.44A, II.44B, II.45A, II.45B, II.46A, II.46B, II.47A, II.47B, II.48A, II.48B, II.49A, II.49B, II.50A, II.50B, II.51A, II.51B, II.52A, II.52B, II.53A, II.53B, II.54A, II.54B, II.55A, II.55B, II.56A, II.56B, II.57A, II.57B, II.58A, II.58B, II.59A, II.59B, II.60A, II.60B, II.61A, II.61B, II.62A, II.62B, II.63A, II.63B, II.64A, II.64B, II.65A, II.65B, II.66, II.67A, II.67B, II.68A, II.68B, II.69A, II.69B, II.70A, II.70B, II.71A, II.71B, II.72A, II.72B, II.73A, II.73B, II.74A, II.74B, II.75A, II.75B, II.76A, II.76B, II.77A, II.77B, II.78A, or II.78B, e.g., the targeting domains of 21 or more nucleotides may comprise the 20-mer HDR-enhancing gRNAs described in Tables II.1A, II.1B, II.2A, II.2B, II.3A, II.3B, II.4A, II.4B, II.5A, II.5B, II.6A, II.6B, II.7A, II.7B, II.8A, II.8B, II.9A, II.9B, II.10A, II.10B, II.11A, II.11B, II.12A, II.12B, II.13A, II.13B, II.14A, II.14B, II.15A, II.15B, II.16A, II.16B, II.17A, II.17B, II.18A, II.18B, II.19A, II.19B, II.20A, II.20B, II.21A, II.21B, II.22A, II.22B, II.23A, II.23B, II.24A, II.24B, II.25A, II.25B, II.26A, II.26B, II.27A, II.27B, II.28A, II.28B, II.29A, II.29B, II.30A, II.30B, II.31A, II.31B, II.32A, II.32B, II.33A, II.33B, II.34A, II.34B, II.35A, II.35B, II.36A, II.36B, II.37A, II.37B, II.38A, II.38B, II.39A, II.39B, II.40A, II.40B, II.41A, II.41B, II.42A, II.42B, II.43A, II.43B, II.44A, II.44B, II.45A, II.45B, II.46A, II.46B, II.47A, II.47B, II.48A, II.48B, II.49A, II.49B, II.50A, II.50B, II.51A, II.51B, II.52A, II.52B, II.53A, II.53B, II.54A, II.54B, II.55A, II.55B, II.56A, II.56B, II.57A, II.57B, II.58A, II.58B, II.59A, II.59B, II.60A, II.60B, II.61A, II.61B, II.62A, II.62B, II.63A, II.63B, II.64A, II.64B, II.65A, II.65B, II.66, II.67A, II.67B, II.68A, II.68B, II.69A, II.69B, II.70A, II.70B, II.71A, II.71B, II.72A, II.72B, II.73A, II.73B, II.74A, II.74B, II.75A, II.75B, II.76A, II.76B, II.77A, II.77B, II.78A, or II.78B. In some embodiments, the targeting domains, disclosed herein, may comprises the 21-mer described in Tables II.1A, II.1B, II.2A, II.2B, II.3A, II.3B, II.4A, II.4B, II.5A, II.5B, II.6A, II.6B, II.7A, II.7B, II.8A, II.8B, II.9A, II.9B, II.10A, II.10B, II.11A, II.11B, II.12A, II.12B, II.13A, II.13B, II.14A, II.14B, II.15A, II.15B, II.16A, II.16B, II.17A, II.17B, II.18A, II.18B, II.19A, II.19B, II.20A, II.20B, II.21A, II.21B, II.22A, II.22B, II.23A, II.23B, II.24A, II.24B, II.25A, II.25B, II.26A, II.26B, II.27A, II.27B, II.28A, II.28B, II.29A, II.29B, II.30A, II.30B, II.31A, II.31B, II.32A, II.32B, II.33A, II.33B, II.34A, II.34B, II.35A, II.35B, II.36A, II.36B, II.37A, II.37B, II.38A, II.38B, II.39A, II.39B, II.40A, II.40B, II.41A, II.41B, II.42A, II.42B, II.43A, II.43B, II.44A, II.44B, II.45A, II.45B, II.46A, II.46B, II.47A, II.47B, II.48A, II.48B, II.49A, II.49B, II.50A, II.50B, II.51A, II.51B, II.52A, II.52B, II.53A, II.53B, II.54A, II.54B, II.55A, II.55B, II.56A, II.56B, II.57A, II.57B, II.58A, II.58B, II.59A, II.59B, II.60A, II.60B, II.61A, II.61B, II.62A, II.62B, II.63A, II.63B, II.64A, II.64B, II.65A, II.65B, II.66, II.67A, II.67B, II.68A, II.68B, II.69A, II.69B, II.70A, II.70B, II.71A, II.71B, II.72A, II.72B, II.73A, II.73B, II.74A, II.74B, II.75A, II.75B, II.76A, II.76B, II.77A, II.77B, II.78A, or II.78B, e.g., the targeting domains of 22 or more nucleotides may comprise the 21-mer HDR-enhancing gRNAs described in Tables II.1A, II.1B, II.2A, II.2B, II.3A, II.3B, II.4A, II.4B, II.5A, II.5B, II.6A, II.6B, II.7A, II.7B, II.8A, II.8B, II.9A, II.9B, II.10A, II.10B, II.11A, II.11B, II.12A, II.12B, II.13A, II.13B, II.14A, II.14B, II.15A, II.15B, II.16A, II.16B, II.17A, II.17B, II.18A, II.18B, II.19A, II.19B, II.20A, II.20B, II.21A, II.21B, II.22A, II.22B, II.23A, II.23B, II.24A, II.24B, II.25A, II.25B, II.26A, II.26B, II.27A, II.27B, II.28A, II.28B, II.29A, II.29B, II.30A, II.30B, II.31A, II.31B, II.32A, II.32B, II.33A, II.33B, II.34A, II.34B, II.35A, II.35B, II.36A, II.36B, II.37A, II.37B, II.38A, II.38B, II.39A, II.39B, II.40A, II.40B, II.41A, II.41B, II.42A, II.42B, II.43A, II.43B, II.44A, II.44B, II.45A, II.45B, II.46A, II.46B, II.47A, II.47B, II.48A, II.48B, II.49A, II.49B, II.50A, II.50B, II.51A, II.51B, II.52A, II.52B, II.53A, II.53B, II.54A, II.54B, II.55A, II.55B, II.56A, II.56B, II.57A, II.57B, II.58A, II.58B, II.59A, II.59B, II.60A, II.60B, II.61A, II.61B, II.62A, II.62B, II.63A, II.63B, II.64A, II.64B, II.65A, II.65B, II.66, II.67A, II.67B, II.68A, II.68B, II.69A, II.69B, II.70A, II.70B, II.71A, II.71B, II.72A, II.72B, II.73A, II.73B, II.74A, II.74B, II.75A, II.75B, II.76A, II.76B, II.77A, II.77B, II.78A, or II.78B. In some embodiments, the targeting domains, disclosed herein, may comprises the 22-mer described in Tables II.1A, II.1B, II.2A, II.2B, II.3A, II.3B, II.4A, II.4B, II.5A, II.5B, II.6A, II.6B, II.7A, II.7B, II.8A, II.8B, II.9A, II.9B, II.10A, II.10B, II.11A, II.11B, II.12A, II.12B, II.13A, II.13B, II.14A, II.14B, II.15A, II.15B, II.16A, II.16B, II.17A, II.17B, II.18A, II.18B, II.19A, II.19B, II.20A, II.20B, II.21A, II.21B, II.22A, II.22B, II.23A, II.23B, II.24A, II.24B, II.25A, II.25B, II.26A, II.26B, II.27A, II.27B, II.28A, II.28B, II.29A, II.29B, II.30A, II.30B, II.31A, II.31B, II.32A, II.32B, II.33A, II.33B, II.34A, II.34B, II.35A, II.35B, II.36A, II.36B, II.37A, II.37B, II.38A, II.38B, II.39A, II.39B, II.40A, II.40B, II.41A, II.41B, II.42A, II.42B, II.43A, II.43B, II.44A, II.44B, II.45A, II.45B, II.46A, II.46B, II.47A, II.47B, II.48A, II.48B, II.49A, II.49B, II.50A, II.50B, II.51A, II.51B, II.52A, II.52B, II.53A, II.53B, II.54A, II.54B, II.55A, II.55B, II.56A, II.56B, II.57A, II.57B, II.58A, II.58B, II.59A, II.59B, II.60A, II.60B, II.61A, II.61B, II.62A, II.62B, II.63A, II.63B, II.64A, II.64B, II.65A, II.65B, II.66, II.67A, II.67B, II.68A, II.68B, II.69A, II.69B, II.70A, II.70B, II.71A, II.71B, II.72A, II.72B, II.73A, II.73B, II.74A, II.74B, II.75A, II.75B, II.76A, II.76B, II.77A, II.77B, II.78A, or II.78B, e.g., the targeting domains of 23 or more nucleotides may comprise the 22-mer HDR-enhancing gRNAs described in Tables II.1A, II.1B, II.2A, II.2B, II.3A, II.3B, II.4A, II.4B, II.5A, II.5B, II.6A, II.6B, II.7A, II.7B, II.8A, II.8B, II.9A, II.9B, II.10A, II.10B, II.11A, II.11B, II.12A, II.12B, II.13A, II.13B, II.14A, II.14B, II.15A, II.15B, II.16A, II.16B, II.17A, II.17B, II.18A, II.18B, II.19A, II.19B, II.20A, II.20B, II.21A, II.21B, II.22A, II.22B, II.23A, II.23B, II.24A, II.24B, II.25A, II.25B, II.26A, II.26B, II.27A, II.27B, II.28A, II.28B, II.29A, II.29B, II.30A, II.30B, II.31A, II.31B, II.32A, II.32B, II.33A, II.33B, II.34A, II.34B, II.35A, II.35B, II.36A, II.36B, II.37A, II.37B, II.38A, II.38B, II.39A, II.39B, II.40A, II.40B, II.41A, II.41B, II.42A, II.42B, II.43A, II.43B, II.44A, II.44B, II.45A, II.45B, II.46A, II.46B, II.47A, II.47B, II.48A, II.48B, II.49A, II.49B, II.50A, II.50B, II.51A, II.51B, II.52A, II.52B, II.53A, II.53B, II.54A, II.54B, II.55A, II.55B, II.56A, II.56B, II.57A, II.57B, II.58A, II.58B, II.59A, II.59B, II.60A, II.60B, II.61A, II.61B, II.62A, II.62B, II.63A, II.63B, II.64A, II.64B, II.65A, II.65B, II.66, II.67A, II.67B, II.68A, II.68B, II.69A, II.69B, II.70A, II.70B, II.71A, II.71B, II.72A, II.72B, II.73A, II.73B, II.74A, II.74B, II.75A, II.75B, II.76A, II.76B, II.77A, II.77B, II.78A, or II.78B. In some embodiments, the targeting domains, disclosed herein, may comprises the 23-mer described in Tables II.1A, II.1B, II.2A, II.2B, II.3A, II.3B, II.4A, II.4B, II.5A, II.5B, II.6A, II.6B, II.7A, II.7B, II.8A, II.8B, II.9A, II.9B, II.10A, II.10B, II.11A, II.11B, II.12A, II.12B, II.13A, II.13B, II.14A, II.14B, II.15A, II.15B, II.16A, II.16B, II.17A, II.17B, II.18A, II.18B, II.19A, II.19B, II.20A, II.20B, II.21A, II.21B, II.22A, II.22B, II.23A, II.23B, II.24A, II.24B, II.25A, II.25B, II.26A, II.26B, II.27A, II.27B, II.28A, II.28B, II.29A, II.29B, II.30A, II.30B, II.31A, II.31B, II.32A, II.32B, II.33A, II.33B, II.34A, II.34B, II.35A, II.35B, II.36A, II.36B, II.37A, II.37B, II.38A, II.38B, II.39A, II.39B, II.40A, II.40B, II.41A, II.41B, II.42A, II.42B, II.43A, II.43B, II.44A, II.44B, II.45A, II.45B, II.46A, II.46B, II.47A, II.47B, II.48A, II.48B, II.49A, II.49B, II.50A, II.50B, II.51A, II.51B, II.52A, II.52B, II.53A, II.53B, II.54A, II.54B, II.55A, II.55B, II.56A, II.56B, II.57A, II.57B, II.58A, II.58B, II.59A, II.59B, II.60A, II.60B, II.61A, II.61B, II.62A, II.62B, II.63A, II.63B, II.64A, II.64B, II.65A, II.65B, II.66, II.67A, II.67B, II.68A, II.68B, II.69A, II.69B, II.70A, II.70B, II.71A, II.71B, II.72A, II.72B, II.73A, II.73B, II.74A, II.74B, II.75A, II.75B, II.76A, II.76B, II.77A, II.77B, II.78A, or II.78B, e.g., the targeting domains of 24 or more nucleotides may comprise the 23-mer HDR-enhancing gRNAs described in Tables II.1A, II.1B, II.2A, II.2B, II.3A, II.3B, II.4A, II.4B, II.5A, II.5B, II.6A, II.6B, II.7A, II.7B, II.8A, II.8B, II.9A, II.9B, II.10A, II.10B, II.11A, II.11B, II.12A, II.12B, II.13A, II.13B, II.14A, II.14B, II.15A, II.15B, II.16A, II.16B, II.17A, II.17B, II.18A, II.18B, II.19A, II.19B, II.20A, II.20B, II.21A, II.21B, II.22A, II.22B, II.23A, II.23B, II.24A, II.24B, II.25A, II.25B, II.26A, II.26B, II.27A, II.27B, II.28A, II.28B, II.29A, II.29B, II.30A, II.30B, II.31A, II.31B, II.32A, II.32B, II.33A, II.33B, II.34A, II.34B, II.35A, II.35B, II.36A, II.36B, II.37A, II.37B, II.38A, II.38B, II.39A, II.39B, II.40A, II.40B, II.41A, II.41B, II.42A, II.42B, II.43A, II.43B, II.44A, II.44B, II.45A, II.45B, II.46A, II.46B, II.47A, II.47B, II.48A, II.48B, II.49A, II.49B, II.50A, II.50B, II.51A, II.51B, II.52A, II.52B, II.53A, II.53B, II.54A, II.54B, II.55A, II.55B, II.56A, II.56B, II.57A, II.57B, II.58A, II.58B, II.59A, II.59B, II.60A, II.60B, II.61A, II.61B, II.62A, II.62B, II.63A, II.63B, II.64A, II.64B, II.65A, II.65B, II.66, II.67A, II.67B, II.68A, II.68B, II.69A, II.69B, II.70A, II.70B, II.71A, II.71B, II.72A, II.72B, II.73A, II.73B, II.74A, II.74B, II.75A, II.75B, II.76A, II.76B, II.77A, II.77B, II.78A, or II.78B. In some embodiments, the targeting domains, disclosed herein, may comprises the 24-mer described in Tables II.1A, II.1B, II.2A, II.2B, II.3A, II.3B, II.4A, II.4B, II.5A, II.5B, II.6A, II.6B, II.7A, II.7B, II.8A, II.8B, II.9A, II.9B, II.10A, II.10B, II.11A, II.11B, II.12A, II.12B, II.13A, II.13B, II.14A, II.14B, II.15A, II.15B, II.16A, II.16B, II.17A, II.17B, II.18A, II.18B, II.19A, II.19B, II.20A, II.20B, II.21A, II.21B, II.22A, II.22B, II.23A, II.23B, II.24A, II.24B, II.25A, II.25B, II.26A, II.26B, II.27A, II.27B, II.28A, II.28B, II.29A, II.29B, II.30A, II.30B, II.31A, II.31B, II.32A, II.32B, II.33A, II.33B, II.34A, II.34B, II.35A, II.35B, II.36A, II.36B, II.37A, II.37B, II.38A, II.38B, II.39A, II.39B, II.40A, II.40B, II.41A, II.41B, II.42A, II.42B, II.43A, II.43B, II.44A, II.44B, II.45A, II.45B, II.46A, II.46B, II.47A, II.47B, II.48A, II.48B, II.49A, II.49B, II.50A, II.50B, II.51A, II.51B, II.52A, II.52B, II.53A, II.53B, II.54A, II.54B, II.55A, II.55B, II.56A, II.56B, II.57A, II.57B, II.58A, II.58B, II.59A, II.59B, II.60A, II.60B, II.61A, II.61B, II.62A, II.62B, II.63A, II.63B, II.64A, II.64B, II.65A, II.65B, II.66, II.67A, II.67B, II.68A, II.68B, II.69A, II.69B, II.70A, II.70B, II.71A, II.71B, II.72A, II.72B, II.73A, II.73B, II.74A, II.74B, II.75A, II.75B, II.76A, II.76B, II.77A, II.77B, II.78A, or II.78B, e.g., the targeting domains of 25 or more nucleotides may comprise the 24-mer HDR-enhancing gRNAs described in Tables II.1A, II.1B, II.2A, II.2B, II.3A, II.3B, II.4A, II.4B, II.5A, II.5B, II.6A, II.6B, II.7A, II.7B, II.8A, II.8B, II.9A, II.9B, II.10A, II.10B, II.11A, II.11B, II.12A, II.12B, II.13A, II.13B, II.14A, II.14B, II.15A, II.15B, II.16A, II.16B, II.17A, II.17B, II.18A, II.18B, II.19A, II.19B, II.20A, II.20B, II.21A, II.21B, II.22A, II.22B, II.23A, II.23B, II.24A, II.24B, II.25A, II.25B, II.26A, II.26B, II.27A, II.27B, II.28A, II.28B, II.29A, II.29B, II.30A, II.30B, II.31A, II.31B, II.32A, II.32B, II.33A, II.33B, II.34A, II.34B, II.35A, II.35B, II.36A, II.36B, II.37A, II.37B, II.38A, II.38B, II.39A, II.39B, II.40A, II.40B, II.41A, II.41B, II.42A, II.42B, II.43A, II.43B, II.44A, II.44B, II.45A, II.45B, II.46A, II.46B, II.47A, II.47B, II.48A, II.48B, II.49A, II.49B, II.50A, II.50B, II.51A, II.51B, II.52A, II.52B, II.53A, II.53B, II.54A, II.54B, II.55A, II.55B, II.56A, II.56B, II.57A, II.57B, II.58A, II.58B, II.59A, II.59B, II.60A, II.60B, II.61A, II.61B, II.62A, II.62B, II.63A, II.63B, II.64A, II.64B, II.65A, II.65B, II.66, II.67A, II.67B, II.68A, II.68B, II.69A, II.69B, II.70A, II.70B, II.71A, II.71B, II.72A, II.72B, II.73A, II.73B, II.74A, II.74B, II.75A, II.75B, II.76A, II.76B, II.77A, II.77B, II.78A, or II.78B.

The targeting domains discussed herein can be incorporated into any of the HDR-enhancing gRNAs described herein.

HDR-enhancing gRNAs were identified and ranked into 4 tiers for *S. pyogenes* (Tables II.1A, II.1B, II.3A, II.3B, II.5A, II.5B, II.7A, II.7B, II.9A, II.9B, II.11A, II.11B, II.13A, II.13B, II.15A, II.15B, II.17A, II.17B, II.19A, II.19B, II.21A, II.21B, II.23A, II.23B, II.25A, II.25B, II.27A, II.27B, II.29A, II.29B, II.31A, II.31B, II.33A, II.33B, II.35A, II.35B, II.37A, II.37B, II.39A, II.39B, II.41A, II.41B, II.43A, II.43B, II.45A, II.45B, II.47A, II.47B, II.49A, II.49B, II.51A, II.51B, II.53A, II.53B, II.55A, II.55B, II.57A, II.57B, II.59A, II.59B, II.61A, II.61B, II.63A, II.63B, II.65A, II.65B, II.67A, II.67B, II.69A, II.69B, II.71A, II.71B, II.73A, II.73B, II.75A, II.75B, II.77A, II.77B) and 5 tiers for *S. aureus* (Tables II.2A, II.2B, II.4A, II.4B, II.6A, II.6B, II.8A, II.8B, II.10A, II.10B, II.12A, II.12B, II.14A, II.14B, II.16A, II.16B, II.18A, II.18B, II.20A, II.20B, II.22A, II.22B, II.24A, II.24B, II.26A, II.26B, II.28A, II.28B, II.30A, II.30B, II.32A, II.32B, II.34A, II.34B, II.36A, II.36B, II.38A, II.38B, II.40A, II.40B, II.42A, II.42B, II.44A, II.44B, II.46A, II.46B, II.48A, II.48B, II.50A, II.50B, II.52A, II.52B, II.54A, II.54B, II.56A, II.56B, II.58A, II.58B, II.60A, II.60B, II.62A, II.62B, II.64A, II.64B, II.66, II.68A, II.68B, II.70A, II.70B, II.72A, II.72B, II.74A, II.74B, II.76A, II.76B, II.78A, or II.78B).

For *S. pyogenes*, the targeting domains for tier 1 HDR-enhancing gRNA molecules were selected based on (1) distance to a target site (e.g., within 500 bp spanning a transcription start site (TSS), e.g., upstream or downstream of a TSS, (2) a high level of orthogonality and (3) the presence of 5'G. The targeting domain for tier 2 HDR-enhancing gRNA molecules were selected based on (1) distance to a target site (e.g., within 500 bp spanning a transcription start site (TSS), e.g., upstream or downstream of a TSS and (2) a high level of orthogonality. The targeting domain for tier 3 HDR-enhancing gRNA molecules were selected based on (1) distance to a target site (e.g., within 500 bp spanning a transcription start site (TSS), e.g., upstream or downstream of a TSS and (2) the presence of 5'G. The targeting domain for tier 4 HDR-enhancing gRNA molecules were selected based on distance to a target site (e.g., within 500 bp spanning a transcription start site (TSS), e.g., upstream or downstream of a TSS.

For *S. aureus*, the targeting domain for tier 1 HDR-enhancing gRNA molecules were selected based on (1) distance to a target site (e.g., within 500 bp spanning a transcription start site (TSS), e.g., upstream or downstream of a TSS, (2) a high level of orthogonality, (3) the presence of 5'G and (4) PAM is NNGRRT. The targeting domain for tier HDR-enhancing 2 gRNA molecules were selected based on (1) distance to a target site (e.g., within 500 bp spanning a transcription start site (TSS), e.g., upstream or downstream of a TSS, (2) a high level of orthogonality, and (3) PAM is NNGRRT. The targeting domain for tier 3 HDR-enhancing gRNA molecules were selected based on (1) distance to a target site (e.g., within 500 bp spanning a transcription start site (TSS), e.g., upstream or downstream of a TSS and (2) PAM is NNGRRT. The targeting domain for tier 4 HDR-enhancing gRNA molecules were selected based on (1) distance to a target site (e.g., within 500 bp spanning a transcription start site (TSS), e.g., upstream or downstream of a TSS and (2) PAM is NNGRRT. The targeting domain for tier 5 HDR-enhancing gRNA molecules were selected based on (1) distance to a target site (e.g., within 500 bp spanning a transcription start site (TSS), e.g., upstream or downstream of a TSS and (2) PAM is NNGRRV.

Note that tiers are non-inclusive (each HDR-enhancing gRNA is listed only once for the strategy). In some instances, no HDR-enhancing gRNA was identified based on the criteria of the particular tier.

Exemplary HDR-Enhancing gRNAs Targeting the Genes Listed in Table I are Listed in Tables II.2A-II.78B.

Table II.1A provides exemplary targeting domains of gRNAs to be used with an eiCas9 fusion molecule (e.g., an eiCas9 fused to a transcription activator or repressor domain) to alter (e.g., activate or repress) a gene, e.g., TP53BP1 gene. The targeting domains of gRNAs were selected according to the first tier parameters. The targeting domains bind within 500 bp spanning a transcription start site (TSS), e.g., upstream or downstream of a TSS, have a high level of orthogonality and start with a 5'G. It is contemplated herein that in an embodiment the targeting domain hybridizes to the target domain through complementary base pairing. Any of the targeting domains in the table can be used with a *S. pyogenes* eiCas9 fusion molecule (e.g., an eiCas9 fused to a transcription activator or repressor domain) to alter (e.g., activate or repress) the TP53BP1 gene. One or more gRNA may be used to target an eiCas9 fusion molecule to a region spanning 500 bp of a transcription start site (TSS) of the TP53BP1 gene.

TABLE II.1A

Exemplary HDR-enhancing gRNAs Targeting a TP53B1 Gene

A high level of orthogonality, and starts with a G

| S. pyogenes 1st Tier gRNA Name | DNA Strand | Targeting Domain | Target Site Length | Seq ID |
|---|---|---|---|---|
| TP53BP1-1 | + | GACCUAGGGAUCGAUCUGGA | 20 | 387 |
| TP53BP1-2 | + | GACCUCUAGCUCGAGCGCGA | 20 | 388 |
| TP53BP1-3 | + | GACGGGAAAGGGGGAGUUCG | 20 | 389 |
| TP53BP1-4 | + | GAGCGCGAGGGACCUCCCGC | 20 | 390 |
| TP53BP1-5 | + | GAGUUCGCGGCCGGUGGCGG | 20 | 391 |
| TP53BP1-6 | + | GAUCGAUCUGGAGGGACUUG | 20 | 392 |
| TP53BP1-7 | − | GCUGUCGCCACCGCCGCCAC | 20 | 393 |
| TP53BP1-8 | + | GGAAAGGGGGAGUUCGCGGC | 20 | 394 |
| TP53BP1-9 | + | GGACCUCCCGCCGGGAUGCC | 20 | 395 |
| TP53BP1-10 | + | GGAUCGAUCUGGAGGGACUU | 20 | 396 |
| TP53BP1-11 | + | GGGAUCGAUCUGGAGGGACU | 20 | 397 |
| TP53BP1-12 | + | GGGAUUUCUUGAGUGGCGGG | 20 | 398 |

TABLE II.1A-continued

Exemplary HDR-enhancing gRNAs Targeting a TP53B1 Gene

A high level of orthogonality, and starts with a G 1A

| S. pyogenes 1st Tier gRNA Name | DNA Strand | Targeting Domain | Target Site Length | Seq ID |
|---|---|---|---|---|
| TP53BP1-13 | + | GGGGAGUUCGCGGCCGGUGG | 20 | 399 |
| TP53BP1-14 | + | GGUACUGUUUGGAGAGAAAU | 20 | 400 |
| TP53BP1-15 | + | GGUGGCGACAGCGGCGACCU | 20 | 401 |
| TP53BP1-16 | − | GUACCAGGCAUCCCGGCGGG | 20 | 402 |
| TP53BP1-17 | − | GUCCCUCCAGAUCGAUCCCU | 20 | 403 |
| TP53BP1-18 | − | GUCCCUCGCGCUCGAGCUAG | 20 | 404 |
| TP53BP1-19 | + | GUGGCGACAGCGGCGACCUA | 20 | 405 |
| TP53BP1-20 | + | GUGUGACGUGACGGGAAAGG | 20 | 406 |

Table II.1B provides exemplary targeting domains of gRNAs to be used with an eiCas9 fusion molecule (e.g., an eiCas9 fused to a transcription activator or repressor domain) to alter (e.g., activate or repress) a gene, e.g., TP53BP1 gene. The targeting domains of gRNAs were selected according to the second tier parameters. The targeting domains bind within 500 bp spanning a transcription start site (TSS), e.g., upstream or downstream of a TSS and have a high level of orthogonality. It is contemplated herein that in an embodiment the targeting domain hybridizes to the target domain through complementary base pairing. Any of the targeting domains in the table can be used with a S. pyogenes eiCas9 fusion molecule (e.g., an eiCas9 fused to a transcription activator or repressor domain) to alter (e.g., activate or repress) the TP53BP1 gene. One or more gRNA may be used to target an eiCas9 fusion molecule to a region spanning 500 bp of a transcription start site (TSS) of the TP53BP1 gene.

TABLE II.1B

Exemplary HDR-enhancing gRNAs Targeting a TP53B1 Gene

A high level of orthogonality 1B

| S. pyogenes 2nd Tier gRNA Name | DNA Strand | Targeting Domain | Target Site Length | Seq ID |
|---|---|---|---|---|
| TP53BP1-21 | − | AACAGUACCAGGCAUCCCGG | 20 | 407 |
| TP53BP1-22 | + | AAGGGGGAGUUCGCGGCCGG | 20 | 408 |
| TP53BP1-23 | − | ACAGUACCAGGCAUCCCGGC | 20 | 409 |
| TP53BP1-24 | + | AGACCUCUAGCUCGAGCGCG | 20 | 410 |
| TP53BP1-25 | + | AGCGCGAGGGACCUCCCGCC | 20 | 411 |

TABLE II.1B-continued

Exemplary HDR-enhancing gRNAs Targeting a TP53B1 Gene

A high level of orthogonality 1B

| S. pyogenes 2nd Tier gRNA Name | DNA Strand | Targeting Domain | Target Site Length | Seq ID |
|---|---|---|---|---|
| TP53BP1-26 | + | AUUGUGUGACGUGACGGGAA | 20 | 412 |
| TP53BP1-27 | + | AUUUCUUGAGUGGCGGGCGG | 20 | 413 |
| TP53BP1-28 | − | CAAGAAAUCCCGUGGAUGAU | 20 | 414 |
| TP53BP1-29 | + | CAUCCACGGGAUUUCUUGAG | 20 | 415 |
| TP53BP1-30 | − | CCCGUCACGUCACACAAUAU | 20 | 416 |
| TP53BP1-31 | + | CCGAUAUUGUGUGACGUGAC | 20 | 417 |
| TP53BP1-32 | + | CCGCAGCUACCUAUCAUCCA | 20 | 418 |
| TP53BP1-33 | − | CCGCCACUCAAGAAAUCCCG | 20 | 419 |
| TP53BP1-34 | + | CCGGGAUGCCUGGUACUGUU | 20 | 420 |
| TP53BP1-35 | − | CCGUGGAUGAUAGGUAGCUG | 20 | 421 |
| TP53BP1-36 | + | CGACCUAGGGAUCGAUCUGG | 20 | 422 |
| TP53BP1-37 | + | CGCAGCUACCUAUCAUCCAC | 20 | 423 |
| TP53BP1-38 | + | CGGCGACCUAGGGAUCGAUC | 20 | 424 |
| TP53BP1-39 | + | UCCGAUAUUGUGUGACGUGA | 20 | 425 |
| TP53BP1-40 | + | UGGCGGGCGGCGGCAGCGAA | 20 | 426 |

Table II.2A provides exemplary targeting domains of gRNAs to be used with an eiCas9 fusion molecule (e.g., an eiCas9 fused to a transcription activator or repressor domain) to alter (e.g., activate or repress) a gene, e.g., TP53BP1 gene. The targeting domains of gRNAs were selected according to the first tier parameters. The targeting domains bind within 500 bp spanning a transcription start site (TSS), e.g., upstream or downstream of a TSS, have a high level of orthogonality, start with a 5'G and PAM is NNGRRT. It is contemplated herein that in an embodiment the targeting domain hybridizes to the target domain through complementary base pairing. Any of the targeting domains in the table can be used with a S. aureus eiCas9 fusion molecule (e.g., an eiCas9 fused to a transcription activator or repressor domain) to alter (e.g., activate or repress) the TP53BP1 gene. One or more gRNA may be used to target an eiCas9 fusion molecule to a region spanning 500 bp of a transcription start site (TSS) of the TP53BP1 gene.

TABLE II.2A

Exemplary HDR-enhancing gRNAs Targeting a TP53B1 Gene

A high level of orthogonality, starts with a G, PAM is NNGRRT
2A

| S. aureus 1st Tier gRNA Name | DNA Strand | Targeting Domain | Target Site Length | Seq ID |
|---|---|---|---|---|
| TP53BP1-41 | + | GAGUGCAGUGGGCUCUGAAGGC | 22 | 427 |
| TP53BP1-42 | + | GCGGUGGCGACAGCGGCGACCU | 22 | 428 |

Table II.2B provides exemplary targeting domains of gRNAs to be used with an eiCas9 fusion molecule (e.g., an eiCas9 fused to a transcription activator or repressor domain) to alter (e.g., activate or repress) a gene, e.g., TP53BP1 gene. The targeting domains of gRNAs were selected according to the second tier parameters. The targeting domains bind within 500 bp spanning a transcription start site (TSS), e.g., upstream or downstream of a TSS, have a high level of orthogonality and PAM is NNGRRT. It is contemplated herein that in an embodiment the targeting domain hybridizes to the target domain through complementary base pairing. Any of the targeting domains in the table can be used with a S. aureus eiCas9 fusion molecule (e.g., an eiCas9 fused to a transcription activator or repressor domain) to alter (e.g., activate or repress) the TP53BP1 gene. One or more gRNA may be used to target an eiCas9 fusion molecule to a region spanning 500 bp of a transcription start site (TSS) of the TP53BP1 gene.

TABLE II.2B

Exemplary HDR-enhancing gRNAs Targeting a TP53B1 Gene

S. aureus 2nd Tier — A high level of orthogonality, and PAM is NNGRRT
2B

| gRNA Name | DNA Strand | Targeting Domain | Target Site Length | Seq ID |
|---|---|---|---|---|
| TP53BP1-43 | − | CGCCCGCCACUCAAGAAAUCCC | 22 | 429 |
| TP53BP1-44 | − | CGUGGAUGAUAGGUAGCUGCGG | 22 | 430 |
| TP53BP1-45 | + | CUGGUACUGUUUGGAGAGAAAU | 22 | 431 |
| TP53BP1-46 | + | UACCUAUCAUCCACGGGAUUUC | 22 | 432 |
| TP53BP1-47 | + | UCGAGCGCGAGGGACCUCCCGC | 22 | 433 |
| TP53BP1-48 | + | UCUUGAGUGGCGGGCGGCGGCA | 22 | 434 |
| TP53BP1-49 | + | UGCCGCAGCUACCUAUCAUCCA | 22 | 435 |
| TP53BP1-50 | + | UUGUGUGACGUGACGGGAAAGG | 22 | 436 |
| TP53BP1-51 | − | UUUCCCGUCACGUCACACAAUA | 22 | 437 |

Table II.3A provides exemplary targeting domains of gRNAs to be used with an eiCas9 fusion molecule (e.g., an eiCas9 fused to a transcription activator or repressor domain) to alter (e.g., activate or repress) a gene, e.g., RIF1 gene. The targeting domains of gRNAs were selected according to the first tier parameters. The targeting domains bind within 500 bp spanning a transcription start site (TSS), e.g., upstream or downstream of a TSS, have a high level of orthogonality and start with a 5'G. It is contemplated herein that in an embodiment the targeting domain hybridizes to the target domain through complementary base pairing. Any of the targeting domains in the table can be used with a S. pyogenes eiCas9 fusion molecule (e.g., an eiCas9 fused to a transcription activator or repressor domain) to alter (e.g., activate or repress) the RIF1 gene. One or more gRNA may be used to target an eiCas9 fusion molecule to a region spanning 500 bp of a transcription start site (TSS) of the RIF1 gene.

TABLE II.3A

Exemplary HDR-enhancing gRNAs Targeting a RIF1 Gene

A high level of orthogonality, and starts with a G
3A

| S. pyogenes 1st Tier gRNA Name | DNA Strand | Targeting Domain | Target Site Length | Seq ID |
|---|---|---|---|---|
| RIF1-1 | − | GAACGAGGCAUCUCGCCGCG | 20 | 438 |
| RIF1-2 | − | GAGCUCGACUUUCCCAGCUC | 20 | 439 |

TABLE II.3A-continued

Exemplary HDR-enhancing gRNAs Targeting a RIF1 Gene

A high level of orthogonality, and starts with a G
3A

| S. pyogenes 1st Tier gRNA Name | DNA Strand | Targeting Domain | Target Site Length | Seq ID |
|---|---|---|---|---|
| RIF1-3 | + | GAUAAAUAUCGGGGUGACAG | 20 | 440 |
| RIF1-4 | - | GCCCAGGAGUGCGCGGGAGU | 20 | 441 |
| RIF1-5 | + | GCCGCCAUCUUGGUCUAGGA | 20 | 442 |
| RIF1-6 | - | GCGCGGGAGUAGGUUAGGCC | 20 | 443 |
| RIF1-7 | - | GGAGGAGAUCGGCGGAGGGC | 20 | 444 |
| RIF1-8 | - | GGAGUGCGCGGGAGUAGGUU | 20 | 445 |
| RIF1-9 | - | GGCAGACUGAGGGUUCCCCG | 20 | 446 |
| RIF1-10 | - | GGCAUCUCGCCGCGAGGGGG | 20 | 447 |
| RIF1-11 | + | GGCCCGCCCAGCCGCCAUCU | 20 | 448 |
| RIF1-12 | + | GGCGAGAUGCCUCGUUCCCC | 20 | 449 |
| RIF1-13 | - | GGGAGGAGAUCGGCGGAGGG | 20 | 450 |
| RIF1-14 | - | GGGAGUAGGUUAGGCCUGGC | 20 | 451 |
| RIF1-15 | - | GGGCAGCUUUCAACAGAGGG | 20 | 452 |
| RIF1-16 | + | GGGGUGACAGUGGUAGGCCG | 20 | 453 |
| RIF1-17 | + | GGGUGACAGUGGUAGGCCGC | 20 | 454 |
| RIF1-18 | + | GGUGACAGUGGUAGGCCGCG | 20 | 455 |
| RIF1-19 | + | GUCGAGCUCUGGCAGCGUCU | 20 | 456 |
| RIF1-20 | + | GUGAGUAAACAGCCGGAGCU | 20 | 457 |

TABLE II.3B

Exemplary HDR-enhancing gRNAs Targeting a RIF1 Gene

A high level of orthogonality
3B

| S. pyogenes 2nd Tier gRNA Name | DNA Strand | Targeting Domain | Target Site Length | Seq ID |
|---|---|---|---|---|
| RIF1-21 | + | AACCUACUCCCGCGCACUCC | 20 | 458 |
| RIF1-22 | - | AACGAGGCAUCUCGCCGCGA | 20 | 459 |
| RIF1-23 | + | AAUAUCGGGGUGACAGUGGU | 20 | 460 |
| RIF1-24 | - | ACGAGGCAUCUCGCCGCGAG | 20 | 461 |
| RIF1-25 | + | AGGGAGGCGAUCGAUAACUC | 20 | 462 |
| RIF1-26 | + | AGUCGAGCUCUGGCAGCGUC | 20 | 463 |
| RIF1-27 | - | CCACCUAGGAAGAUCAGGAC | 20 | 464 |
| RIF1-28 | - | CCCCGAUAUUUAUCCCACCU | 20 | 465 |
| RIF1-29 | - | CCUAGACCAAGAUGGCGGCU | 20 | 466 |
| RIF1-30 | - | CGAGGCAUCUCGCCGCGAGG | 20 | 467 |
| RIF1-31 | + | CGCACGCGUGAGUAAACAGC | 20 | 468 |
| RIF1-32 | + | CGGCGAGAUGCCUCGUUCCC | 20 | 469 |
| RIF1-33 | + | CGUGAGUAAACAGCCGGAGC | 20 | 470 |
| RIF1-34 | - | UCCAACAGUCAGCGGCACAC | 20 | 471 |
| RIF1-35 | + | UCCGGUGUGCCGCUGACUGU | 20 | 472 |
| RIF1-36 | - | UCUCGCCGCGAGGGGCGGA | 20 | 473 |
| RIF1-37 | + | UGGCUCGAACUUCUCCCGCC | 20 | 474 |
| RIF1-38 | + | UGUGCCGCUGACUGUUGGAU | 20 | 475 |
| RIF1-39 | - | UUAUCCCACCUAGGAAGAUC | 20 | 476 |
| RIF1-40 | + | UUCCUAGGUGGGAUAAAUAU | 20 | 477 |

Table II.3B provides exemplary targeting domains of gRNAs to be used with an eiCas9 fusion molecule (e.g., an eiCas9 fused to a transcription activator or repressor domain) to alter (e.g., activate or repress) a gene, e.g., RIF1 gene. The targeting domains of gRNAs were selected according to the second tier parameters. The targeting domains bind within 500 bp spanning a transcription start site (TSS), e.g., upstream or downstream of a TSS and have a high level of orthogonality. It is contemplated herein that in an embodiment the targeting domain hybridizes to the target domain through complementary base pairing. Any of the targeting domains in the table can be used with a S. pyogenes eiCas9 fusion molecule (e.g., an eiCas9 fused to a transcription activator or repressor domain) to alter (e.g., activate or repress) the RIF1 gene. One or more gRNA may be used to target an eiCas9 fusion molecule to a region spanning 500 bp of a transcription start site (TSS) of the RIF1 gene.

Table II.4A provides exemplary targeting domains of gRNAs to be used with an eiCas9 fusion molecule (e.g., an eiCas9 fused to a transcription activator or repressor domain) to alter (e.g., activate or repress) a gene, e.g., RIF1 gene. The targeting domains of gRNAs were selected according to the first tier parameters. The targeting domains bind within 500 bp spanning a transcription start site (TSS), e.g., upstream or downstream of a TSS, have a high level of orthogonality, start with a 5'G and PAM is NNGRRT. It is contemplated herein that in an embodiment the targeting domain hybridizes to the target domain through complementary base pairing. Any of the targeting domains in the table can be used with a S. aureus eiCas9 fusion molecule (e.g., an eiCas9 fused to a transcription activator or repressor domain) to alter (e.g., activate or repress) the RIF1 gene. One or more gRNA may be used to target an eiCas9 fusion molecule to a region spanning 500 bp of a transcription start site (TSS) of the RIF1 gene.

TABLE II.4A

Exemplary HDR-enhancing gRNAs Targeting a RIF1 Gene

A high level of orthogonality, starts with a G, PAM is NNGRRT
4A

| S. aureus 1st Tier gRNA Name | DNA Strand | Targeting Domain | Target Site Length | Seq ID |
|---|---|---|---|---|
| RIF1-41 | + | GAAAGUCGAGCUCUGGCAGCGU | 22 | 478 |
| RIF1-42 | − | GGCAUCUCGCCGCGAGGGGCG | 22 | 479 |
| RIF1-43 | − | GGGGGCGGAGGGUGGGCAGACU | 22 | 480 |

Table II.4B provides exemplary targeting domains of gRNAs to be used with an eiCas9 fusion molecule (e.g., an eiCas9 fused to a transcription activator or repressor domain) to alter (e.g., activate or repress) a gene, e.g., RIF1 gene. The targeting domains of gRNAs were selected according to the second tier parameters. The targeting domains bind within 500 bp spanning a transcription start site (TSS), e.g., upstream or downstream of a TSS, have a high level of orthogonality and PAM is NNGRRT. It is contemplated herein that in an embodiment the targeting domain hybridizes to the target domain through complementary base pairing. Any of the targeting domains in the table can be used with a S. aureus eiCas9 fusion molecule (e.g., an eiCas9 fused to a transcription activator or repressor domain) to alter (e.g., activate or repress) the RIF1 gene. One or more gRNA may be used to target an eiCas9 fusion molecule to a region spanning 500 bp of a transcription start site (TSS) of the RIF1 gene.

TABLE II.4B

Exemplary HDR-enhancing gRNAs Targeting a RIF1 Gene

S. aureus    A high level of orthogonality, and PAM is NNGRRT
4B

| 2nd Tier gRNA Name | DNA Strand | Targeting Domain | Target Site Length | Seq ID |
|---|---|---|---|---|
| RIF1-44 | + | AACUCCGGUGUGCCGCUGACUG | 22 | 481 |
| RIF1-45 | − | AAGAUGGCGGCUGGGCGGGCCC | 22 | 482 |
| RIF1-46 | − | AAUCCAACAGUCAGCGGCACAC | 22 | 483 |
| RIF1-47 | + | ACCCUGUCCUGAUCUUCCUAGG | 22 | 484 |
| RIF1-48 | − | AUCCCACCUAGGAAGAUCAGGA | 22 | 485 |
| RIF1-49 | − | CUGGGCGGGCCCAGGAGUGCGC | 22 | 486 |
| RIF1-50 | + | UAGGAGGGAGCGCGCCGCACGC | 22 | 487 |
| RIF1-51 | + | UCUUCCUAGGUGGGAUAAAUAU | 22 | 488 |

Table II.5A provides exemplary targeting domains of gRNAs to be used with an eiCas9 fusion molecule (e.g., an eiCas9 fused to a transcription activator or repressor domain) to alter (e.g., activate or repress) a gene, e.g., PAXIP1 gene. The targeting domains of gRNAs were selected according to the first tier parameters. The targeting domains bind within 500 bp spanning a transcription start site (TSS), e.g., upstream or downstream of a TSS, have a high level of orthogonality and start with a 5'G. It is contemplated herein that in an embodiment the targeting domain hybridizes to the target domain through complementary base pairing. Any of the targeting domains in the table can be used with a S. pyogenes eiCas9 fusion molecule (e.g., an eiCas9 fused to a transcription activator or repressor domain) to alter (e.g., activate or repress) the PAXIP1 gene. One or more gRNA may be used to target an eiCas9 fusion molecule to a region spanning 500 bp of a transcription start site (TSS) of the PAXIP1 gene.

TABLE II.5A

Exemplary HDR-enhancing gRNAs Targeting a PAXIP1 Gene

A high level of orthogonality, and starts with a G
5A

| S. pyogenes 1st Tier gRNA Name | DNA Strand | Targeting Domain | Target Site Length | Seq ID |
|---|---|---|---|---|
| PAXIP1-1 | − | GAACAUCUCCUCAGGAACUU | 20 | 489 |
| PAXIP1-2 | − | GCCCCCACUCGCCCCGCCAA | 20 | 490 |

TABLE II.5A-continued

Exemplary HDR-enhancing gRNAs Targeting a PAXIP1 Gene

A high level of orthogonality, and starts with a G
5A

| S. pyogenes 1st Tier gRNA Name | DNA Strand | Targeting Domain | Target Site Length | Seq ID |
|---|---|---|---|---|
| PAXIP1-3 | + | GCCGUUGGCGGGGCGAGUGG | 20 | 491 |
| PAXIP1-4 | - | GCGCCGAGCGCCCGAAGCGC | 20 | 492 |
| PAXIP1-5 | + | GCGCCGCCGCGGAGCCUCCC | 20 | 493 |
| PAXIP1-6 | + | GCGCGCGGCUCCCGCGCUUC | 20 | 494 |
| PAXIP1-7 | + | GCGCGGGCAGGGCCGUUGGC | 20 | 495 |
| PAXIP1-8 | + | GCGCUCCCCCUCGGUGGCCG | 20 | 496 |
| PAXIP1-9 | + | GCGGGAUGGUGCGUCCCGCA | 20 | 497 |
| PAXIP1-10 | + | GCUCCCGCGCUUCGGGCGCU | 20 | 498 |
| PAXIP1-11 | + | GGACCCCGAUUCGCAGGACC | 20 | 499 |
| PAXIP1-12 | + | GGACCGGGCCCGGGCUGCGC | 20 | 500 |
| PAXIP1-13 | + | GGCCGUUGGCGGGGCGAGUG | 20 | 501 |
| PAXIP1-14 | + | GGCGCUCCCCCUCGGUGGCC | 20 | 502 |
| PAXIP1-15 | + | GGCGGGAUGGUGCGUCCCGC | 20 | 503 |
| PAXIP1-16 | + | GGCUGCGCGGGCAGGGCCGU | 20 | 504 |
| PAXIP1-17 | - | GGGAGCCGCGCGCGCCCUGC | 20 | 505 |
| PAXIP1-18 | + | GGGAGCGGACCCCGAUUCGC | 20 | 506 |
| PAXIP1-19 | - | GGGCCCGGUCCUGCGAAUCG | 20 | 507 |
| PAXIP1-20 | + | GGGCCGUUGGCGGGGCGAGU | 20 | 508 |

TABLE II.5B

Exemplary HDR-enhancing gRNAs Targeting a PAXIP1 Gene

A high level of orthogonality
5B

| S. pyogenes 2nd Tier gRNA Name | DNA Strand | Targeting Domain | Target Site Length | Seq ID |
|---|---|---|---|---|
| PAXIP1-21 | - | AACAUCUCCUCAGGAACUUU | 20 | 509 |
| PAXIP1-22 | - | CAUGAUCGCGGCGGCCCGGG | 20 | 510 |
| PAXIP1-23 | + | CCAGGCGCCCAAAGUUCCUG | 20 | 511 |
| PAXIP1-24 | - | CCGACAUGAUCGCGGCGGCC | 20 | 512 |
| PAXIP1-25 | + | CCGAUUCGCAGGACCGGGCC | 20 | 513 |
| PAXIP1-26 | - | CCGGGCCCGGUCCUGCGAAU | 20 | 514 |
| PAXIP1-27 | + | CCGGGCCGCCGCGAUCAUGU | 20 | 515 |
| PAXIP1-28 | - | CCUCAGGAACUUUGGGCGCC | 20 | 516 |
| PAXIP1-29 | - | CGACAUGAUCGCGGCGGCCC | 20 | 517 |
| PAXIP1-30 | + | CGAUUCGCAGGACCGGGCCC | 20 | 518 |
| PAXIP1-31 | + | CGCCGCGAUCAUGUCGGACC | 20 | 519 |
| PAXIP1-32 | - | CGCCUGGUCCGACAUGAUCG | 20 | 520 |
| PAXIP1-33 | - | CGCGCCGAGCGCCCGAAGCG | 20 | 521 |
| PAXIP1-34 | + | CGCGCGCGGCUCCCGCGCUU | 20 | 522 |
| PAXIP1-35 | + | CGCGCUUCGGGCGCUCGGCG | 20 | 523 |
| PAXIP1-36 | + | CGGACCCCGAUUCGCAGGAC | 20 | 524 |
| PAXIP1-37 | - | CGGGACGCACCAUCCCGCCC | 20 | 525 |
| PAXIP1-38 | - | CGGGCCCGGUCCUGCGAAUC | 20 | 526 |
| PAXIP1-39 | - | CUGGUCCGACAUGAUCGCGG | 20 | 527 |
| PAXIP1-40 | + | UGCGUCCCGCAGGGCGCGCG | 20 | 528 |

Table II.5B provides exemplary targeting domains of gRNAs to be used with an eiCas9 fusion molecule (e.g., an eiCas9 fused to a transcription activator or repressor domain) to alter (e.g., activate or repress) a gene, e.g., PAXIP1 gene. The targeting domains of gRNAs were selected according to the second tier parameters. The targeting domains bind within 500 bp spanning a transcription start site (TSS), e.g., upstream or downstream of a TSS and have a high level of orthogonality. It is contemplated herein that in an embodiment the targeting domain hybridizes to the target domain through complementary base pairing. Any of the targeting domains in the table can be used with a S. pyogenes eiCas9 fusion molecule (e.g., an eiCas9 fused to a transcription activator or repressor domain) to alter (e.g., activate or repress) the PAXIP1 gene. One or more gRNA may be used to target an eiCas9 fusion molecule to a region spanning 500 bp of a transcription start site (TSS) of the PAXIP1 gene.

Table II.6A provides exemplary targeting domains of gRNAs to be used with an eiCas9 fusion molecule (e.g., an eiCas9 fused to a transcription activator or repressor domain) to alter (e.g., activate or repress) a gene, e.g., PAXIP1 gene. The targeting domains of gRNAs were selected according to the first tier parameters. The targeting domains bind within 500 bp spanning a transcription start site (TSS), e.g., upstream or downstream of a TSS, have a high level of orthogonality, start with a 5'G and PAM is NNGRRT. It is contemplated herein that in an embodiment the targeting domain hybridizes to the target domain through complementary base pairing. Any of the targeting domains in the table can be used with a S. aureus eiCas9 fusion molecule (e.g., an eiCas9 fused to a transcription activator or repressor domain) to alter (e.g., activate or repress) the PAXIP1 gene. One or more gRNA may be used to target an eiCas9 fusion molecule to a region spanning 500 bp of a transcription start site (TSS) of the PAXIP1 gene.

TABLE II.6A

Exemplary HDR-enhancing gRNAs Targeting a PAXIP1 Gene

A high level of orthogonality, starts with a G, PAM is NNGRRT
6A

| S. aureus 1st Tier gRNA Name | DNA Strand | Targeting Domain | Target Site Length | Seq ID |
|---|---|---|---|---|
| PAXIP1-41 | − | GCCCGGGCCCGGUCCUGCGAAU | 22 | 529 |
| PAXIP1-42 | + | GGCGCCGCGGGGGCCGGGGGCG | 22 | 530 |

Table II.6B provides exemplary targeting domains of gRNAs to be used with an eiCas9 fusion molecule (e.g., an eiCas9 fused to a transcription activator or repressor domain) to alter (e.g., activate or repress) a gene, e.g., PAXIP1 gene. The targeting domains of gRNAs were selected according to the second tier parameters. The targeting domains bind within 500 bp spanning a transcription start site (TSS), e.g., upstream or downstream of a TSS, have a high level of orthogonality and PAM is NNGRRT. It is contemplated herein that in an embodiment the targeting domain hybridizes to the target domain through complementary base pairing. Any of the targeting domains in the table can be used with a S. aureus eiCas9 fusion molecule (e.g., an eiCas9 fused to a transcription activator or repressor domain) to alter (e.g., activate or repress) the PAXIP1 gene. One or more gRNA may be used to target an eiCas9 fusion molecule to a region spanning 500 bp of a transcription start site (TSS) of the PAXIP1 gene.

TABLE II.6B

Exemplary HDR-enhancing gRNAs Targeting a PAXIP1 Gene

A high level of orthogonality, and PAM is NNGRRT
6B

| S. aureus 2nd Tier gRNA Name | DNA Strand | Targeting Domain | Target Site Length | Seq ID |
|---|---|---|---|---|
| PAXIP1-43 | − | CGCGCAGCCCGGGCCCGGUCCU | 22 | 531 |
| PAXIP1-44 | + | CGCGGGCAGGGCCGUUGGCGGG | 22 | 532 |
| PAXIP1-45 | + | CGCUCCCCCUCGGUGGCCGGGG | 22 | 533 |

Table II.7A provides exemplary targeting domains of gRNAs to be used with an eiCas9 fusion molecule (e.g., an eiCas9 fused to a transcription activator or repressor domain) to alter (e.g., activate or repress) a gene, e.g., XRCC6 gene. The targeting domains of gRNAs were selected according to the first tier parameters. The targeting domains bind within 500 bp spanning a transcription start site (TSS), e.g., upstream or downstream of a TSS, have a high level of orthogonality and start with a 5'G. It is contemplated herein that in an embodiment the targeting domain hybridizes to the target domain through complementary base pairing. Any of the targeting domains in the table can be used with a S. pyogenes eiCas9 fusion molecule (e.g., an eiCas9 fused to a transcription activator or repressor domain) to alter (e.g., activate or repress) the XRCC6 gene. One or more gRNA may be used to target an eiCas9 fusion molecule to a region spanning 500 bp of a transcription start site (TSS) of the XRCC6 gene.

TABLE II.7A

Exemplary HDR-enhancing gRNAs Targeting a XRCC6 Gene

A high level of orthogonality, and starts with a G
7A

| S. pyogenes 1st Tier gRNA Name | DNA Strand | Targeting Domain | Target Site Length | Seq ID |
|---|---|---|---|---|
| XRCC6-1 | − | GACGACAAUCCACGCAUGCG | 20 | 534 |
| XRCC6-2 | − | GAGCGAAGCGGGACGAGGCC | 20 | 535 |
| XRCC6-3 | + | GAGGCGGCACCUCGCGUUUG | 20 | 536 |
| XRCC6-4 | + | GAGGGCCCACACGGAAGAGG | 20 | 537 |
| XRCC6-5 | − | GAGGUGCCGCCUCCUUCCCG | 20 | 538 |
| XRCC6-6 | − | GAUAACGGCCCGCUUACCUU | 20 | 539 |
| XRCC6-7 | + | GCACAUGCGUGAUGACGUAG | 20 | 540 |
| XRCC6-8 | − | GCAUGCGCGGGCCCUGUACU | 20 | 541 |
| XRCC6-9 | + | GCCCCAUAGCCUUGCUAGA | 20 | 542 |
| XRCC6-10 | − | GCCCCGCCCCUUCCUACGUC | 20 | 543 |
| XRCC6-11 | − | GCCCGCUUACCUUUGGCGCA | 20 | 544 |
| XRCC6-12 | + | GCCUUAAGUGUGCGAAUCCG | 20 | 545 |
| XRCC6-13 | − | GCGAGACCGACCGAGCGAAG | 20 | 546 |
| XRCC6-14 | + | GGACAUAGGUAGAAGCUGGU | 20 | 547 |
| XRCC6-15 | − | GGCCCGCUUACCUUUGGCGC | 20 | 548 |
| XRCC6-16 | + | GGGCGGGGCUUUGCCGAAGG | 20 | 549 |
| XRCC6-17 | + | GGGGCGGGGCUCUCGCUGAU | 20 | 550 |
| XRCC6-18 | + | GGGGCGGGGCUUUGCCGAAG | 20 | 551 |
| XRCC6-19 | + | GUACAGGGCCCGCGCAUGCG | 20 | 552 |
| XRCC6-20 | + | GUUGAUUGGGACCGAGUACA | 20 | 553 |

Table II.7B provides exemplary targeting domains of gRNAs to be used with an eiCas9 fusion molecule (e.g., an eiCas9 fused to a transcription activator or repressor domain) to alter (e.g., activate or repress) a gene, e.g., XRCC6 gene. The targeting domains of gRNAs were selected according to the second tier parameters. The targeting domains bind within 500 bp spanning a transcription start site (TSS), e.g., upstream or downstream of a TSS and have a high level of orthogonality. It is contemplated herein that in an embodiment the targeting domain hybridizes to the target domain through complementary base pairing. Any of the targeting domains in the table can be used with a S. pyogenes eiCas9 fusion molecule (e.g., an eiCas9 fused to a transcription activator or repressor domain) to alter (e.g., activate or repress) the XRCC6 gene. One or more gRNA may be used to target an eiCas9 fusion molecule to a region spanning 500 bp of a transcription start site (TSS) of the XRCC6 gene.

TABLE II.7B

Exemplary HDR-enhancing gRNAs Targeting a XRCC6 Gene

A high level of orthogonality
7B

| S. pyogenes 2nd Tier gRNA Name | DNA Strand | Targeting Domain | Target Site Length | Seq ID |
|---|---|---|---|---|
| XRCC6-21 | + | ACCACGCUCCUUCCUCGGGA | 20 | 554 |
| XRCC6-22 | − | ACGACAAUCCACGCAUGCGC | 20 | 555 |
| XRCC6-23 | + | AUGACGUAGAGGGCGUUGAU | 20 | 556 |
| XRCC6-24 | + | CACAUGCGUGAUGACGUAGA | 20 | 557 |
| XRCC6-25 | − | CGACCGAGCGAAGCGGGACG | 20 | 558 |
| XRCC6-26 | − | CGAGACCGACCGAGCGAAGC | 20 | 559 |
| XRCC6-27 | − | CGCACUAUAUCGCGUCAGGC | 20 | 560 |
| XRCC6-28 | + | CGCCCCAUAGCCUUGCUAG | 20 | 561 |
| XRCC6-29 | + | CGGGGCUCUCGCUGAUGGGU | 20 | 562 |
| XRCC6-30 | + | CGUUGAUUGGGACCGAGUAC | 20 | 563 |
| XRCC6-31 | − | CUAACGCUAACCCUCUAGCA | 20 | 564 |
| XRCC6-32 | + | CUCGUCCCGCUUCGCUCGGU | 20 | 565 |
| XRCC6-33 | + | CUGAUGGGUUGGCUUUCGUC | 20 | 566 |
| XRCC6-34 | + | UCCCUGCGCCAAAGGUAAGC | 20 | 567 |
| XRCC6-35 | − | UCCUCGGAUUCGCACACUUA | 20 | 568 |
| XRCC6-36 | − | UCGAGUCUGUCGCUGCUCCU | 20 | 569 |
| XRCC6-37 | + | UGACGUAGAGGGCGUUGAUU | 20 | 570 |
| XRCC6-38 | + | UGGUCGCUUCCCUGCGCCAA | 20 | 571 |
| XRCC6-39 | − | UGUGCGCACUAUAUCGCGUC | 20 | 572 |
| XRCC6-40 | + | UGUUGUUCGCCAGCUAGGCC | 20 | 573 |

Table II.8A provides exemplary targeting domains of gRNAs to be used with an eiCas9 fusion molecule (e.g., an eiCas9 fused to a transcription activator or repressor domain) to alter (e.g., activate or repress) a gene, e.g., XRCC6 gene. The targeting domains of gRNAs were selected according to the first tier parameters. The targeting domains bind within 500 bp spanning a transcription start site (TSS), e.g., upstream or downstream of a TSS, have a high level of orthogonality, start with a 5′G and PAM is NNGRRT. It is contemplated herein that in an embodiment the targeting domain hybridizes to the target domain through complementary base pairing. Any of the targeting domains in the table can be used with a S. aureus eiCas9 fusion molecule (e.g., an eiCas9 fused to a transcription activator or repressor domain) to alter (e.g., activate or repress) the XRCC6 gene. One or more gRNA may be used to target an eiCas9 fusion molecule to a region spanning 500 bp of a transcription start site (TSS) of the XRCC6 gene.

TABLE II.8A

Exemplary HDR-enhancing gRNAs Targeting a XRCC6 Gene

A high level of orthogonality, starts with a G, PAM is NNGRRT
8A

| S. aureus 1st Tier gRNA Name | DNA Strand | Targeting Domain | Target Site Length | Seq ID |
|---|---|---|---|---|
| XRCC6-41 | + | GAAGGGGCGGGGCUCUCGCUG | 22 | 574 |
| XRCC6-42 | − | GCCUAGCUGGCGAACAACACAA | 22 | 575 |
| XRCC6-43 | + | GCGCGCCCCCAUAGCCUUGCUA | 22 | 576 |
| XRCC6-44 | + | GGACAUAGGUAGAAGCUGGUUG | 22 | 577 |
| XRCC6-45 | + | GGUUAGCGUUAGCCUUAAGUGU | 22 | 578 |
| XRCC6-46 | − | GUCUCGAGUCUGUCGCUGCUCC | 22 | 579 |

Table II.8B provides exemplary targeting domains of gRNAs to be used with an eiCas9 fusion molecule (e.g., an eiCas9 fused to a transcription activator or repressor domain) to alter (e.g., activate or repress) a gene, e.g., XRCC6 gene. The targeting domains of gRNAs were selected according to the second tier parameters. The targeting domains bind within 500 bp spanning a transcription start site (TSS), e.g., upstream or downstream of a TSS, have a high level of orthogonality and PAM is NNGRRT. It is contemplated herein that in an embodiment the targeting domain hybridizes to the target domain through complementary base pairing. Any of the targeting domains in the table can be used with a S. aureus eiCas9 fusion molecule (e.g., an eiCas9 fused to a transcription activator or repressor domain) to alter (e.g., activate or repress) the XRCC6 gene. One or more gRNA may be used to target an eiCas9 fusion molecule to a region spanning 500 bp of a transcription start site (TSS) of the XRCC6 gene.

TABLE II.8B

Exemplary HDR-enhancing gRNAs Targeting a XRCC6 Gene

A high level of orthogonality, and PAM is NNGRRT
8B

| S. aureus 2nd Tier gRNA Name | DNA Strand | Targeting Domain | Target Site Length | Seq ID |
|---|---|---|---|---|
| XRCC6-47 | + | ACACGGAAGAGGGGCGGGGGC | 22 | 580 |
| XRCC6-48 | + | ACGUAGAGGGCGUUGAUUGGGA | 22 | 581 |
| XRCC6-49 | + | CGAGUACAGGGCCCGCGCAUGC | 22 | 582 |
| XRCC6-50 | − | UUCCCGAGGAAGGAGCGUGGUC | 22 | 583 |

Table II.9A provides exemplary targeting domains of gRNAs to be used with an eiCas9 fusion molecule (e.g., an eiCas9 fused to a transcription activator or repressor domain) to alter (e.g., activate or repress) a gene, e.g., XRCC5 gene. The targeting domains of gRNAs were selected according to the first tier parameters. The targeting domains bind within 500 bp spanning a transcription start site (TSS), e.g., upstream or downstream of a TSS, have a high level of orthogonality and start with a 5′G. It is contemplated herein that in an embodiment the targeting domain hybridizes to the target domain through complementary base pairing. Any of the targeting domains in the table can be used with a S. pyogenes eiCas9 fusion molecule (e.g., an eiCas9 fused to a transcription activator or repressor domain) to alter (e.g., activate or repress) the XRCC5 gene. One or more gRNA may be used to target an eiCas9 fusion molecule to a region spanning 500 bp of a transcription start site (TSS) of the XRCC5 gene.

TABLE II.9A

Exemplary HDR-enhancing gRNAs Targeting a XRCC5 Gene

A high level of orthogonality, and starts with a G
9A

| S. pyogenes 1st Tier gRNA Name | DNA Strand | Targeting Domain | Target Site Length | Seq ID |
|---|---|---|---|---|
| XRCC5-1 | + | GAAGCGAGUUGCGACACGGC | 20 | 584 |
| XRCC5-2 | + | GACCGGCAACAUGGUGCGGU | 20 | 585 |
| XRCC5-3 | + | GACUUGGGCUUUACCCGGAC | 20 | 586 |
| XRCC5-4 | + | GAGAAUGUGCGCAUGCUCGG | 20 | 587 |
| XRCC5-5 | - | GAGCCGCUUCGUUUCCUGCU | 20 | 588 |
| XRCC5-6 | - | GCACCAUGUUGCCGGUCCUC | 20 | 589 |
| XRCC5-7 | - | GCCGUGUCGCAACUCGCUUC | 20 | 590 |
| XRCC5-8 | + | GCGCCUGAGGACCGGCAACA | 20 | 591 |
| XRCC5-9 | - | GCGCUUUGGUCGCUUCUUCC | 20 | 592 |
| XRCC5-10 | + | GCUAUCUGCCGCUUGUCCAC | 20 | 593 |
| XRCC5-11 | + | GGAAUCUGCGCGAGCUCGGC | 20 | 594 |
| XRCC5-12 | + | GGAGAGAAUGUGCGCAUGCU | 20 | 595 |
| XRCC5-13 | + | GGCCGGAAUCUGCGCGAGCU | 20 | 596 |
| XRCC5-14 | - | GGCGCUUUGGUCGCUUCUUC | 20 | 597 |
| XRCC5-15 | + | GGGAAUCUGCGCAAGCUCGG | 20 | 598 |
| XRCC5-16 | + | GGGAAUCUGCGCAUGCUCGG | 20 | 599 |
| XRCC5-17 | - | GGGGCGGGGAAACCGUGCCC | 20 | 600 |
| XRCC5-18 | - | GGUGGACAAGCGGCAGAUAG | 20 | 601 |
| XRCC5-19 | - | GUGUCGCAACUCGCUUCCGG | 20 | 602 |
| XRCC5-20 | - | GUUUCCUGCUAGGCCUGAAA | 20 | 603 |

Table II.9B provides exemplary targeting domains of gRNAs to be used with an eiCas9 fusion molecule (e.g., an eiCas9 fused to a transcription activator or repressor domain) to alter (e.g., activate or repress) a gene, e.g., XRCC5 gene. The targeting domains of gRNAs were selected according to the second tier parameters. The targeting domains bind within 500 bp spanning a transcription start site (TSS), e.g., upstream or downstream of a TSS and have a high level of orthogonality. It is contemplated herein that in an embodiment the targeting domain hybridizes to the target domain through complementary base pairing. Any of the targeting domains in the table can be used with a S. pyogenes eiCas9 fusion molecule (e.g., an eiCas9 fused to a transcription activator or repressor domain) to alter (e.g., activate or repress) the XRCC5 gene. One or more gRNA may be used to target an eiCas9 fusion molecule to a region spanning 500 bp of a transcription start site (TSS) of the XRCC5 gene.

TABLE II.9B

Exemplary HDR-enhancing gRNAs Targeting a XRCC5 Gene

A high level of orthogonality
9B

| S. pyogenes 2nd Tier gRNA Name | DNA Strand | Targeting Domain | Target Site Length | Seq ID |
|---|---|---|---|---|
| XRCC5-21 | + | ACCGGAAGCGAGUUGCGACA | 20 | 604 |
| XRCC5-22 | + | ACCGGCAACAUGGUGCGGUC | 20 | 605 |
| XRCC5-23 | + | ACGGUUUCCCCGCCCCUUUC | 20 | 606 |
| XRCC5-24 | - | ACUCGCUUCCGGUGGACAAG | 20 | 607 |
| XRCC5-25 | + | ACUUGGGCUUUACCCGGACU | 20 | 608 |
| XRCC5-26 | + | AGAAGCGACCAAAGCGCCUG | 20 | 609 |
| XRCC5-27 | + | CAUGGUGCGGUCGGGGAAUA | 20 | 610 |
| XRCC5-28 | + | CCACACGCUCCCGACUACGG | 20 | 611 |
| XRCC5-29 | + | CCGCCCCUUUCAGGCCUAGC | 20 | 612 |
| XRCC5-30 | - | CCGCCGUAGUCGGGAGCGUG | 20 | 613 |
| XRCC5-31 | + | CCGGCAACAUGGUGCGGUCG | 20 | 614 |
| XRCC5-32 | - | CGCCGAGCUCGCGCAGAUUC | 20 | 615 |
| XRCC5-33 | + | CGCUCCCGACUACGGCGGAA | 20 | 616 |
| XRCC5-34 | - | CGUUUCCUGCUAGGCCUGAA | 20 | 617 |
| XRCC5-35 | - | CUCUCCAUUCCGCCGUAGUC | 20 | 618 |
| XRCC5-36 | + | CUGCGCAUGCUCAGAGUUCC | 20 | 619 |
| XRCC5-37 | - | UCUCUCCAUUCCGCCGUAGU | 20 | 620 |
| XRCC5-38 | + | UGCGCAUGCUCAGAGUUCCG | 20 | 621 |
| XRCC5-39 | - | UUGCCGGUCCUCAGGCGCUU | 20 | 622 |
| XRCC5-40 | - | UUUGGUCGCUUCUUCCGGGC | 20 | 623 |

Table II.10A provides exemplary targeting domains of gRNAs to be used with an eiCas9 fusion molecule (e.g., an eiCas9 fused to a transcription activator or repressor domain) to alter (e.g., activate or repress) a gene, e.g., XRCC5 gene. The targeting domains of gRNAs were selected according to the first tier parameters. The targeting domains bind within 500 bp spanning a transcription start site (TSS), e.g., upstream or downstream of a TSS, have a high level of orthogonality, start with a 5'G and PAM is NNGRRT. It is contemplated herein that in an embodiment the targeting domain hybridizes to the target domain through complementary base pairing. Any of the targeting domains in the table can be used with a S. aureus eiCas9 fusion molecule (e.g., an eiCas9 fused to a transcription activator or repressor domain) to alter (e.g., activate or repress) the XRCC5 gene. One or more gRNA may be used to target an eiCas9 fusion molecule to a region spanning 500 bp of a transcription start site (TSS) of the XRCC5 gene.

TABLE II.10A

Exemplary HDR-enhancing gRNA Targeting a XRCC5 Gene

A high level of orthogonality, starts with a G, PAM is NNGRRT
10A

| S. aureus 1st Tier gRNA Name | DNA Strand | Targeting Domain | Target Site Length | Seq ID |
|---|---|---|---|---|
| XRCC5-41 | + | GACCGGCAACAUGGUGCGGUCG | 22 | 624 |

Table II.10B provides exemplary targeting domains of gRNAs to be used with an eiCas9 fusion molecule (e.g., an eiCas9 fused to a transcription activator or repressor domain) to alter (e.g., activate or repress) a gene, e.g., XRCC5 gene. The targeting domains of gRNAs were selected according to the second tier parameters. The targeting domains bind within 500 bp spanning a transcription start site (TSS), e.g., upstream or downstream of a TSS, have a high level of orthogonality and PAM is NNGRRT. It is contemplated herein that in an embodiment the targeting domain hybridizes to the target domain through complementary base pairing. Any of the targeting domains in the table can be used with a S. aureus eiCas9 fusion molecule (e.g., an eiCas9 fused to a transcription activator or repressor domain) to alter (e.g., activate or repress) the XRCC5 gene. One or more gRNA may be used to target an eiCas9 fusion molecule to a region spanning 500 bp of a transcription start site (TSS) of the XRCC5 gene.

TABLE II.10B

Exemplary HDR-enhancing gRNAs Targeting a XRCC5 Gene

A high level of orthogonality, and PAM is NNGRRT
10B

| S. aureus 2nd Tier gRNA Name | DNA Strand | Targeting Domain | Target Site Length | Seq ID |
|---|---|---|---|---|
| XRCC5-42 | + | AGAGAAUCUGCGCAUGCUCGGC | 22 | 625 |
| XRCC5-43 | + | AGAGAAUGUGCGCAUGCUCGGC | 22 | 626 |
| XRCC5-44 | + | AUCUGCCGCUUGUCCACCGGAA | 22 | 627 |
| XRCC5-45 | + | CACCACACGCUCCCGACUACGG | 22 | 628 |
| XRCC5-46 | + | CCGGAAUCUGCGCGAGCUCGGC | 22 | 629 |
| XRCC5-47 | + | CGGGAAUCUGCGCAAGCUCGGC | 22 | 630 |
| XRCC5-48 | + | CGGGAAUCUGCGCAUGCUCGGA | 22 | 631 |
| XRCC5-49 | + | CGGGAAUCUGCGCAUGCUCGGC | 22 | 632 |
| XRCC5-50 | + | CUCCCGACUACGGCGGAAUGGA | 22 | 633 |
| XRCC5-51 | + | UCGGCGGGAAUCUGCGCAUGCU | 22 | 634 |

Table II.11A provides exemplary targeting domains of gRNAs to be used with an eiCas9 fusion molecule (e.g., an eiCas9 fused to a transcription activator or repressor domain) to alter (e.g., activate or repress) a gene, e.g., PRKDC gene. The targeting domains of gRNAs were selected according to the first tier parameters. The targeting domains bind within 500 bp spanning a transcription start site (TSS), e.g., upstream or downstream of a TSS, have a high level of orthogonality and start with a 5'G. It is contemplated herein that in an embodiment the targeting domain hybridizes to the target domain through complementary base pairing. Any of the targeting domains in the table can be used with a S. pyogenes eiCas9 fusion molecule (e.g., an eiCas9 fused to a transcription activator or repressor domain) to alter (e.g., activate or repress) the PRKDC gene. One or more gRNA may be used to target an eiCas9 fusion molecule to a region spanning 500 bp of a transcription start site (TSS) of the PRKDC gene.

TABLE II.11A

Exemplary HDR-enhancing gRNAs Targeting a PRKDC Gene

A high level of orthogonality, and starts with a G
11A

| S. pyogenes 1st Tier gRNA Name | DNA Strand | Targeting Domain | Target Site Length | Seq ID |
|---|---|---|---|---|
| PRKDC-1 | + | GCACGCGCGGGAGCGGGACU | 20 | 635 |
| PRKDC-2 | + | GCAGCCCCGCCUCCGCGCGU | 20 | 636 |
| PRKDC-3 | + | GCCUUCCCGCAGGGGUCCCC | 20 | 637 |
| PRKDC-4 | − | GCGCCCGCUCGGCCCGGACC | 20 | 638 |
| PRKDC-5 | − | GCGCGUGCGCCCGCUCGGCC | 20 | 639 |
| PRKDC-6 | − | GCGGCGGCAGGAACUUUCCC | 20 | 640 |
| PRKDC-7 | + | GCGGGACUCGGCGGCAUGGC | 20 | 641 |
| PRKDC-8 | + | GCGGGCGCACGCGCGGGAGC | 20 | 642 |
| PRKDC-9 | − | GGAAAUGCCCCUACGCGCGG | 20 | 643 |
| PRKDC-10 | − | GGAGCAACGCACACCGGCUC | 20 | 644 |
| PRKDC-11 | + | GGCAUGGCGGGCUCCGGAGC | 20 | 645 |
| PRKDC-12 | + | GGCCAAAGAGGCGCGCUUAC | 20 | 646 |
| PRKDC-13 | − | GGCCAGUAAGCGCGCCUCUU | 20 | 647 |
| PRKDC-14 | + | GGCCGAGCGGGCGCACGCGC | 20 | 648 |
| PRKDC-15 | + | GGCCUUCCCGCAGGGGUCCC | 20 | 649 |
| PRKDC-16 | − | GGGACCCCUGCGGGAAGGCC | 20 | 650 |
| PRKDC-17 | + | GGGAGCGGGACUCGGCGGCA | 20 | 651 |
| PRKDC-18 | + | GGGCCGAGCGGGCGCACGCG | 20 | 652 |
| PRKDC-19 | + | GUAGGGGCAUUUCCGGGUCC | 20 | 653 |
| PRKDC-20 | + | GUGUGCGUUGCUCCCUGCUG | 20 | 654 |

Table II.11B provides exemplary targeting domains of gRNAs to be used with an eiCas9 fusion molecule (e.g., an eiCas9 fused to a transcription activator or repressor domain) to alter (e.g., activate or repress) a gene, e.g., PRKDC gene. The targeting domains of gRNAs were selected according to the second tier parameters. The targeting domains bind within 500 bp spanning a transcription start site (TSS), e.g., upstream or downstream of a TSS and have a high level of orthogonality. It is contemplated herein that in an embodiment the targeting domain hybridizes to the target domain through complementary base pairing. Any of the targeting domains in the table can be used with a *S. pyogenes* eiCas9 fusion molecule (e.g., an eiCas9 fused to a transcription activator or repressor domain) to alter (e.g., activate or repress) the PRKDC gene. One or more gRNA may be used to target an eiCas9 fusion molecule to a region spanning 500 bp of a transcription start site (TSS) of the PRKDC gene.

TABLE II.11B

Exemplary HDR-enhancing gRNAs Targeting a PRKDC Gene

A high level of orthogonality 11B

| S. pyogenes 2nd Tier gRNA Name | DNA Strand | Targeting Domain | Target Site Length | Seq ID |
|---|---|---|---|---|
| PRKDC-21 | + | AAGAGGCGCGCUUACUGGCC | 20 | 655 |
| PRKDC-22 | − | AAUGCCCCUACGCGCGGAGG | 20 | 656 |
| PRKDC-23 | − | ACUUUCCCGGGGACCCCUGC | 20 | 657 |
| PRKDC-24 | + | AGCCCCGCCUCCGCGCGUAG | 20 | 658 |
| PRKDC-25 | + | AGCGGGACUCGGCGGCAUGG | 20 | 659 |
| PRKDC-26 | − | AUGCCCCUACGCGCGGAGGC | 20 | 660 |
| PRKDC-27 | + | AUUUCCGGGUCCGGGCCGAG | 20 | 661 |
| PRKDC-28 | + | CAGCCCCGCCUCCGCGCGUA | 20 | 662 |
| PRKDC-29 | + | CAUGUUGAUUCGGGCCAAAG | 20 | 663 |
| PRKDC-30 | − | CCCGGAAAUGCCCCUACGCG | 20 | 664 |
| PRKDC-31 | + | CCGCGCGUAGGGGCAUUCC | 20 | 665 |
| PRKDC-32 | − | CGAAUCAACAUGGAAACCUA | 20 | 666 |
| PRKDC-33 | − | CGCGGCGGCAGGAACUUUCC | 20 | 667 |
| PRKDC-34 | − | CGGCGGCAGGAACUUUCCCG | 20 | 668 |
| PRKDC-35 | + | CGUAGGGGCAUUUCCGGGUC | 20 | 669 |
| PRKDC-36 | + | CUCGGCGGCAUGGCGGGCUC | 20 | 670 |
| PRKDC-37 | − | CUCUUUGGCCCGAAUCAACA | 20 | 671 |
| PRKDC-38 | + | UCCGCGCGUAGGGGCAUUUC | 20 | 672 |
| PRKDC-39 | − | UGCCCCUACGCGCGGAGGCG | 20 | 673 |
| PRKDC-40 | + | UUUCCGGGUCCGGGCCGAGC | 20 | 674 |

Table II.12A provides exemplary targeting domains of gRNAs to be used with an eiCas9 fusion molecule (e.g., an eiCas9 fused to a transcription activator or repressor domain) to alter (e.g., activate or repress) a gene, e.g., PRKDC gene. The targeting domains of gRNAs were selected according to the first tier parameters. The targeting domains bind within 500 bp spanning a transcription start site (TSS), e.g., upstream or downstream of a TSS, have a high level of orthogonality, start with a 5'G and PAM is NNGRRT. It is contemplated herein that in an embodiment the targeting domain hybridizes to the target domain through complementary base pairing. Any of the targeting domains in the table can be used with a *S. aureus* eiCas9 fusion molecule (e.g., an eiCas9 fused to a transcription activator or repressor domain) to alter (e.g., activate or repress) the PRKDC gene. One or more gRNA may be used to target an eiCas9 fusion molecule to a region spanning 500 bp of a transcription start site (TSS) of the PRKDC gene.

TABLE II.12A

Exemplary HDR-enhancing gRNAs Targeting a PRKDC Gene

A high level of orthogonality, starts with a G, PAM is NNGRRT 12A

| S. aureus 1st Tier gRNA Name | DNA Strand | Targeting Domain | Target Site Length | Seq ID |
|---|---|---|---|---|
| PRKDC-41 | + | GCCUCCGCGCGUAGGGGCAUUU | 22 | 675 |
| PRKDC-42 | − | GGCUCCGGAGCCCGCCAUGCCG | 22 | 676 |

Table II.12B provides exemplary targeting domains of gRNAs to be used with an eiCas9 fusion molecule (e.g., an eiCas9 fused to a transcription activator or repressor domain) to alter (e.g., activate or repress) a gene, e.g., PRKDC gene. The targeting domains of gRNAs were selected according to the second tier parameters. The targeting domains bind within 500 bp spanning a transcription start site (TSS), e.g., upstream or downstream of a TSS, have a high level of orthogonality and PAM is NNGRRT. It is contemplated herein that in an embodiment the targeting domain hybridizes to the target domain through complementary base pairing. Any of the targeting domains in the table can be used with a *S. aureus* eiCas9 fusion molecule (e.g., an eiCas9 fused to a transcription activator or repressor domain) to alter (e.g., activate or repress) the PRKDC gene. One or more gRNA may be used to target an eiCas9 fusion molecule to a region spanning 500 bp of a transcription start site (TSS) of the PRKDC gene.

TABLE II.12B

Exemplary HDR-enhancing gRNAs Targeting a PRKDC Gene

A high level of orthogonality, and PAM is NNGRRT 12B

| S. aureus 2nd Tier gRNA Name | DNA Strand | Targeting Domain | Target Site Length | Seq ID |
|---|---|---|---|---|
| PRKDC-43 | − | CCAGUAAGCGCGCCUCUUUGGC | 22 | 677 |
| PRKDC-44 | + | CUUACUGGCCAGGCCUUCCCGC | 22 | 678 |

Table II.13A provides exemplary targeting domains of gRNAs to be used with an eiCas9 fusion molecule (e.g., an eiCas9 fused to a transcription activator or repressor domain) to alter (e.g., activate or repress) a gene, e.g., LIG4 gene. The targeting domains of gRNAs were selected according to the first tier parameters. The targeting domains bind within 500 bp spanning a transcription start site (TSS), e.g., upstream or downstream of a TSS, have a high level of orthogonality and start with a 5'G. It is contemplated herein that in an embodiment the targeting domain hybridizes to the target domain through complementary base pairing. Any of the targeting domains in the table can be used with a *S. pyogenes* eiCas9 fusion molecule (e.g., an eiCas9 fused to a transcription activator or repressor domain) to alter (e.g., activate or repress) the LIG4 gene. One or more gRNA may be used to target an eiCas9 fusion molecule to a region spanning 500 bp of a transcription start site (TSS) of the LIG4 gene.

TABLE II.13A

Exemplary HDR-enhancing gRNAs Targeting a LIG4 Gene

A high level of orthogonality, and starts with a G
13A

| S. pyogenes 1st Tier gRNA Name | DNA Strand | Targeting Domain | Target Site Length | Seq ID |
|---|---|---|---|---|
| LIG4-1 | + | GACGUCAGGUGGGAAGGGUG | 20 | 679 |
| LIG4-2 | − | GCAGCCAGGCUCGCGAUGGG | 20 | 680 |
| LIG4-3 | − | GCAGGCGCAGGGGAGACCCG | 20 | 681 |
| LIG4-4 | − | GCCAGGCUCGCGAUGGGAGG | 20 | 682 |
| LIG4-5 | + | GCCCGGUGACUGCAAGGCCC | 20 | 683 |
| LIG4-6 | − | GCGCAGGCGCAGGGGAGACC | 20 | 684 |
| LIG4-7 | + | GCGCCUGCGCGGCGAGCAGC | 20 | 685 |
| LIG4-8 | − | GCUCGCGAUGGGAGGUGGGG | 20 | 686 |
| LIG4-9 | − | GCUGCUCGCCGCGCAGGCGC | 20 | 687 |
| LIG4-10 | + | GCUUCAGGCUUGACGUCAGG | 20 | 688 |
| LIG4-11 | + | GCUUGAGCCCGGUGACUGCA | 20 | 689 |
| LIG4-12 | − | GGCGCAGCCAGGCUCGCGAU | 20 | 690 |
| LIG4-13 | + | GGCGCCAGCUUCCGGCUUAG | 20 | 691 |
| LIG4-14 | − | GGCUCGCGAUGGGAGGUGGG | 20 | 692 |
| LIG4-15 | + | GGCUUGACGUCAGGUGGGAA | 20 | 693 |
| LIG4-16 | + | GGGGCGGUUGGGAGGUUGGG | 20 | 694 |
| LIG4-17 | + | GGGUCUCCCCUGCGCCUGCG | 20 | 695 |
| LIG4-18 | + | GGUGGCAGGUGGGGCGGUU | 20 | 696 |
| LIG4-19 | − | GUCACCGGGCUCAAGCACGC | 20 | 697 |
| LIG4-20 | + | GUGGGGGCGGUUGGGAGGUU | 20 | 698 |

TABLE II.13B

Exemplary HDR-enhancing gRNAs Targeting a LIG4 Gene

A high level of orthogonality
13B

| S. pyogenes 2nd Tier gRNA Name | DNA Strand | Targeting Domain | Target Site Length | Seq ID |
|---|---|---|---|---|
| LIG4-21 | − | ACCCGGGGCCUUGCAGUCAC | 20 | 699 |
| LIG4-22 | + | ACGUCAGGUGGGAAGGGUGU | 20 | 700 |
| LIG4-23 | + | AGGCUUGACGUCAGGUGGGA | 20 | 701 |
| LIG4-24 | − | CAGGCUCGCGAUGGGAGGUG | 20 | 702 |
| LIG4-25 | + | CAUCGCGAGCCUGGCUGCGC | 20 | 703 |
| LIG4-26 | + | CAUCUUCUGGCGCCAGCUUC | 20 | 704 |
| LIG4-27 | − | CCAGGCUCGCGAUGGGAGGU | 20 | 705 |
| LIG4-28 | + | CCCACCUCCCAUCGCGAGCC | 20 | 706 |
| LIG4-29 | − | CCCGGGGCCUUGCAGUCACC | 20 | 707 |
| LIG4-30 | + | CCCGGUGACUGCAAGGCCCC | 20 | 708 |
| LIG4-31 | − | CGCAGGCGCAGGGGAGACCC | 20 | 709 |
| LIG4-32 | + | CGGCGAGCAGCUGGCGGAAC | 20 | 710 |
| LIG4-33 | − | CGGCGCAGCCAGGCUCGCGA | 20 | 711 |
| LIG4-34 | + | CGGCUUAGCGGCUGAGCUUC | 20 | 712 |
| LIG4-35 | − | CUGAAGCUCAGCCGCUAAGC | 20 | 713 |
| LIG4-36 | + | CUGGCGGAACCGGCAUCUUC | 20 | 714 |
| LIG4-37 | − | UCAAGCACGCCGGCGCAGCC | 20 | 715 |
| LIG4-38 | − | UCAGCCGCUAAGCCGGAAGC | 20 | 716 |
| LIG4-39 | + | UGAGCUUCAGGCUUGACGUC | 20 | 717 |
| LIG4-40 | + | UGCGCCGGCGUGCUUGAGCC | 20 | 718 |

Table II.13B provides exemplary targeting domains of gRNAs to be used with an eiCas9 fusion molecule (e.g., an eiCas9 fused to a transcription activator or repressor domain) to alter (e.g., activate or repress) a gene, e.g., LIG4 gene. The targeting domains of gRNAs were selected according to the second tier parameters. The targeting domains bind within 500 bp spanning a transcription start site (TSS), e.g., upstream or downstream of a TSS and have a high level of orthogonality. It is contemplated herein that in an embodiment the targeting domain hybridizes to the target domain through complementary base pairing. Any of the targeting domains in the table can be used with a S. pyogenes eiCas9 fusion molecule (e.g., an eiCas9 fused to a transcription activator or repressor domain) to alter (e.g., activate or repress) the LIG4 gene. One or more gRNA may be used to target an eiCas9 fusion molecule to a region spanning 500 bp of a transcription start site (TSS) of the LIG4 gene.

Table II.14A provides exemplary targeting domains of gRNAs to be used with an eiCas9 fusion molecule (e.g., an eiCas9 fused to a transcription activator or repressor domain) to alter (e.g., activate or repress) a gene, e.g., LIG4 gene. The targeting domains of gRNAs were selected according to the first tier parameters. The targeting domains bind within 500 bp spanning a transcription start site (TSS), e.g., upstream or downstream of a TSS, have a high level of orthogonality, start with a 5'G and PAM is NNGRRT. It is contemplated herein that in an embodiment the targeting domain hybridizes to the target domain through complementary base pairing. Any of the targeting domains in the table can be used with a S. aureus eiCas9 fusion molecule (e.g., an eiCas9 fused to a transcription activator or repressor domain) to alter (e.g., activate or repress) the LIG4 gene. One or more gRNA may be used to target an eiCas9 fusion molecule to a region spanning 500 bp of a transcription start site (TSS) of the LIG4 gene.

TABLE II.14A

Exemplary HDR-enhancing gRNA Targeting a LIG4 Gene

A high level of orthogonality, starts with a G, PAM is NNGRRT
14A

| S. aureus 1st Tier gRNA Name | DNA Strand | Targeting Domain | Target Site Length | Seq ID |
|---|---|---|---|---|
| LIG4-41 | + | GGUUGGGGGGGUUGGGUGGG | 22 | 719 |

Table II.14B provides exemplary targeting domains of gRNAs to be used with an eiCas9 fusion molecule (e.g., an eiCas9 fused to a transcription activator or repressor domain) to alter (e.g., activate or repress) a gene, e.g., LIG4 gene. The targeting domains of gRNAs were selected according to the second tier parameters. The targeting domains bind within 500 bp spanning a transcription start site (TSS), e.g., upstream or downstream of a TSS, have a high level of orthogonality and PAM is NNGRRT. It is contemplated herein that in an embodiment the targeting domain hybridizes to the target domain through complementary base pairing. Any of the targeting domains in the table can be used with a *S. aureus* eiCas9 fusion molecule (e.g., an eiCas9 fused to a transcription activator or repressor domain) to alter (e.g., activate or repress) the LIG4 gene. One or more gRNA may be used to target an eiCas9 fusion molecule to a region spanning 500 bp of a transcription start site (TSS) of the LIG4 gene.

TABLE II.14B

Exemplary HDR-enhancing gRNAs Targeting a LIG4 Gene

A high level of orthogonality, and PAM is NNGRRT
14B

| S. aureus 2nd Tier gRNA Name | DNA Strand | Targeting Domain | Target Site Length | Seq ID |
|---|---|---|---|---|
| LIG4-42 | + | CGGUUGGGAGGUUGGGGGGGU | 22 | 720 |
| LIG4-43 | + | UGAGCCCGGUGACUGCAAGGCC | 22 | 721 |
| LIG4-44 | + | UGGGGGCGGUUGGGAGGUUGGG | 22 | 722 |
| LIG4-45 | + | UUCAGGCUUGACGUCAGGUGGG | 22 | 723 |
| LIG4-46 | + | UUGACGUCAGGUGGGAAGGGUG | 22 | 724 |

Table II.15A provides exemplary targeting domains of gRNAs to be used with an eiCas9 fusion molecule (e.g., an eiCas9 fused to a transcription activator or repressor domain) to alter (e.g., activate or repress) a gene, e.g., XRCC4 gene. The targeting domains of gRNAs were selected according to the first tier parameters. The targeting domains bind within 500 bp spanning a transcription start site (TSS), e.g., upstream or downstream of a TSS, have a high level of orthogonality and start with a 5'G. It is contemplated herein that in an embodiment the targeting domain hybridizes to the target domain through complementary base pairing. Any of the targeting domains in the table can be used with a *S. pyogenes* eiCas9 fusion molecule (e.g., an eiCas9 fused to a transcription activator or repressor domain) to alter (e.g., activate or repress) the XRCC4 gene. One or more gRNA may be used to target an eiCas9 fusion molecule to a region spanning 500 bp of a transcription start site (TSS) of the XRCC4 gene.

TABLE II.15A

Exemplary HDR-enhancing gRNAs Targeting a XRCC4 Gene

A high level of orthogonality, and starts with a G
15A

| S. pyogenes 1st Tier gRNA Name | DNA Strand | Targeting Domain | Target Site Length | Seq ID |
|---|---|---|---|---|
| XRCC4-1 | + | GAAGUAGCUGAUACUCUCAU | 20 | 725 |
| XRCC4-2 | − | GACAAGCCCAACCGGACGGC | 20 | 726 |
| XRCC4-3 | − | GACGGCUGGAGAGGGCGAGA | 20 | 727 |
| XRCC4-4 | − | GAGAGGGCGAGAAGGGCAGA | 20 | 728 |
| XRCC4-5 | + | GAGAGGUAGGAUCCGGAAGU | 20 | 729 |
| XRCC4-6 | + | GAUCACGUCCCGCAGGCCGG | 20 | 730 |
| XRCC4-7 | − | GAUCUAAAUCCCGCCUUUUC | 20 | 731 |
| XRCC4-8 | + | GCACCGCCUACCAAGACGGG | 20 | 732 |
| XRCC4-9 | − | GCCCAACCGGACGGCUGGAG | 20 | 733 |
| XRCC4-10 | + | GCCCUCUCCAGCCGUCCGGU | 20 | 734 |
| XRCC4-11 | + | GCGGGCGUUUUGGAAGAUAC | 20 | 735 |
| XRCC4-12 | + | GGAGAGGUAGGAUCCGGAAG | 20 | 736 |
| XRCC4-13 | + | GGAUUUAGAUCACGUCCCGC | 20 | 737 |
| XRCC4-14 | + | GGCGGUUAAGACACUAGGAU | 20 | 738 |
| XRCC4-15 | − | GGUGCCGUGACAAGCCCAAC | 20 | 739 |

Table II.15B provides exemplary targeting domains of gRNAs to be used with an eiCas9 fusion molecule (e.g., an eiCas9 fused to a transcription activator or repressor domain) to alter (e.g., activate or repress) a gene, e.g., XRCC4 gene. The targeting domains of gRNAs were selected according to the second tier parameters. The targeting domains bind within 500 bp spanning a transcription start site (TSS), e.g., upstream or downstream of a TSS and have a high level of orthogonality. It is contemplated herein that in an embodiment the targeting domain hybridizes to the target domain through complementary base pairing. Any of the targeting domains in the table can be used with a *S. pyogenes* eiCas9 fusion molecule (e.g., an eiCas9 fused to a transcription activator or repressor domain) to alter (e.g., activate or repress) the XRCC4 gene. One or more gRNA may be used to target an eiCas9 fusion molecule to a region spanning 500 bp of a transcription start site (TSS) of the XRCC4 gene.

TABLE II.15B

Exemplary HDR-enhancing gRNAs Targeting a XRCC4 Gene

A high level of orthogonality
15B

| S. pyogenes 2nd Tier gRNA Name | DNA Strand | Targeting Domain | Target Site Length | Seq ID |
|---|---|---|---|---|
| XRCC4-16 | - | ACGCCCGCUUUCACAGAUCA | 20 | 740 |
| XRCC4-17 | + | ACGGCACCGCCUACCAAGAC | 20 | 741 |
| XRCC4-18 | + | AGACGGGCGGUUAAGACACU | 20 | 742 |
| XRCC4-19 | - | AGAGUAUCAGCUACUUCCGC | 20 | 743 |
| XRCC4-20 | + | AGAUACCGGAAGUAGAGUCA | 20 | 744 |
| XRCC4-21 | - | AGCUACUUCCGCCGGCCUGC | 20 | 745 |
| XRCC4-22 | + | AGUCACGGAGAGGUAGGAUC | 20 | 746 |
| XRCC4-23 | - | AGUGUCUUAACCGCCCGUCU | 20 | 747 |
| XRCC4-24 | + | AUCUGUGAAAGCGGGCGUUU | 20 | 748 |
| XRCC4-25 | + | CACGGCACCGCCUACCAAGA | 20 | 749 |
| XRCC4-26 | - | CCCAACCGGACGGCUGGAGA | 20 | 750 |
| XRCC4-27 | + | CCCUCUCCAGCCGUCCGGUU | 20 | 751 |
| XRCC4-28 | + | CCGGAAGUAGAGUCACGGAG | 20 | 752 |
| XRCC4-29 | + | CCGUCCGGUUGGGCUUGUCA | 20 | 753 |
| XRCC4-30 | - | CCGUGACAAGCCCAACCGGA | 20 | 754 |
| XRCC4-31 | - | CUAAAUCCCGCCUUUUCCGG | 20 | 755 |
| XRCC4-32 | - | UAACCGCCCGUCUUGGUAGG | 20 | 756 |
| XRCC4-33 | - | UCCCGCCUUUUCCGGUGGAG | 20 | 757 |
| XRCC4-34 | - | UCUUAACCGCCCGUCUUGGU | 20 | 758 |
| XRCC4-35 | + | UUAGAUCACGUCCCGCAGGC | 20 | 759 |

Table II.16A provides exemplary targeting domains of gRNAs to be used with an eiCas9 fusion molecule (e.g., an eiCas9 fused to a transcription activator or repressor domain) to alter (e.g., activate or repress) a gene, e.g., XRCC4 gene. The targeting domains of gRNAs were selected according to the first tier parameters. The targeting domains bind within 500 bp spanning a transcription start site (TSS), e.g., upstream or downstream of a TSS, have a high level of orthogonality, start with a 5'G and PAM is NNGRRT. It is contemplated herein that in an embodiment the targeting domain hybridizes to the target domain through complementary base pairing. Any of the targeting domains in the table can be used with a S. aureus eiCas9 fusion molecule (e.g., an eiCas9 fused to a transcription activator or repressor domain) to alter (e.g., activate or repress) the XRCC4 gene. One or more gRNA may be used to target an eiCas9 fusion molecule to a region spanning 500 bp of a transcription start site (TSS) of the XRCC4 gene.

TABLE II.16A

Exemplary HDR-enhancing gRNAs Targeting a XRCC4 Gene

A high level of orthogonality, starts with a G, PAM is NNGRRT
16A

| S. aureus 1st Tier gRNA Name | DNA Strand | Targeting Domain | Target Site Length | Seq ID |
|---|---|---|---|---|
| XRCC4-36 | + | GCGUUUUGGAAGAUACCGGAAG | 22 | 760 |
| XRCC4-37 | + | GGCUCCUCUCCACCGGAAAAGG | 22 | 761 |

Table II.16B provides exemplary targeting domains of gRNAs to be used with an eiCas9 fusion molecule (e.g., an eiCas9 fused to a transcription activator or repressor domain) to alter (e.g., activate or repress) a gene, e.g., XRCC4 gene. The targeting domains of gRNAs were selected according to the second tier parameters. The targeting domains bind within 500 bp spanning a transcription start site (TSS), e.g., upstream or downstream of a TSS, have a high level of orthogonality and PAM is NNGRRT. It is contemplated herein that in an embodiment the targeting domain hybridizes to the target domain through complementary base pairing. Any of the targeting domains in the table can be used with a S. aureus eiCas9 fusion molecule (e.g., an eiCas9 fused to a transcription activator or repressor domain) to alter (e.g., activate or repress) the XRCC4 gene. One or more gRNA may be used to target an eiCas9 fusion molecule to a region spanning 500 bp of a transcription start site (TSS) of the XRCC4 gene.

TABLE II.16B

Exemplary HDR-enhancing gRNAs Targeting a XRCC4 Gene

A high level of orthogonality, and PAM is NNGRRT
16B

| S. aureus 2nd Tier gRNA Name | DNA Strand | Targeting Domain | Target Site Length | Seq ID |
|---|---|---|---|---|
| XRCC4-38 | - | AGAUCAAGGUUUUGCAACCAAU | 22 | 762 |
| XRCC4-39 | - | AUUUAAAGAGGCAGCCCCACUU | 22 | 763 |
| XRCC4-40 | + | CCAAGACGGGCGGUUAAGACAC | 22 | 764 |
| XRCC4-41 | + | CGGAAGUAGAGUCACGGAGAGG | 22 | 765 |

Table II.17A provides exemplary targeting domains of gRNAs to be used with an eiCas9 fusion molecule (e.g., an eiCas9 fused to a transcription activator or repressor domain) to alter (e.g., activate or repress) a gene, e.g., NHEJ1 gene. The targeting domains of gRNAs were selected according to the first tier parameters. The targeting domains bind within 500 bp spanning a transcription start site (TSS), e.g., upstream or downstream of a TSS, have a high level of orthogonality and start with a 5'G. It is contemplated herein that in an embodiment the targeting domain hybridizes to the target domain through complementary base pairing. Any of the targeting domains in the table can be used with a S. pyogenes eiCas9 fusion molecule (e.g., an eiCas9 fused to a transcription activator or repressor domain) to alter (e.g., activate or repress) the NHEJ1 gene. One or more gRNA may be used to target an eiCas9 fusion molecule to a region spanning 500 bp of a transcription start site (TSS) of the NHEJ1 gene.

TABLE II.17A

Exemplary HDR-enhancing gRNAs Targeting a NHEJ1 Gene

A high level of orthogonality, and starts with a G 17A

| S. pyogenes 1st Tier gRNA Name | DNA Strand | Targeting Domain | Target Site Length | Seq ID |
|---|---|---|---|---|
| NHEJ1-1 | + | GCAGUCCGCUGGCUGCUGCC | 20 | 766 |
| NHEJ1-2 | − | GCCAGCGGACUGCGCACGCG | 20 | 767 |
| NHEJ1-3 | − | GCCCGCUCGCGCAAACCGAA | 20 | 768 |
| NHEJ1-4 | + | GCCUUUCGGUUUGCGCGAGC | 20 | 769 |
| NHEJ1-5 | + | GCGACGAAGCCGCUGGUGGC | 20 | 770 |
| NHEJ1-6 | − | GCGAUUCCACCUACCGUCAG | 20 | 771 |
| NHEJ1-7 | − | GCGCUCCCUCCAGGGAGAAA | 20 | 772 |
| NHEJ1-8 | − | GCGGCUUCGUCGCACCAAAC | 20 | 773 |
| NHEJ1-9 | − | GCGUCUGAGCAGCCCCUCGC | 20 | 774 |
| NHEJ1-10 | + | GCUCGAGUGAAGGUACUCGU | 20 | 775 |
| NHEJ1-11 | + | GCUGCCCGGCGUGGAUGGUA | 20 | 776 |
| NHEJ1-12 | + | GCUGCUCAGACGCUGCGGGU | 20 | 777 |
| NHEJ1-13 | − | GGCCUAUGCCUGGCGUGGGC | 20 | 778 |
| NHEJ1-14 | + | GGCCUUUCGGUUUGCGCGAG | 20 | 779 |
| NHEJ1-15 | + | GGCGCUCUCGCGGCCGCUGA | 20 | 780 |
| NHEJ1-16 | − | GGUCUUGGGAUACAGGGGCG | 20 | 781 |
| NHEJ1-17 | + | GGUGGAAUCGCGUUCGAGUC | 20 | 782 |
| NHEJ1-18 | + | GUGCGUGCGGCUAAGAGAGU | 20 | 783 |
| NHEJ1-19 | + | GUGGAAUCGCGUUCGAGUCC | 20 | 784 |
| NHEJ1-20 | + | GUUUGGUGCGACGAAGCCGC | 20 | 785 |

TABLE II.17B

Exemplary HDR-enhancing gRNAs Targeting a NHEJ1 Gene

A high level of orthogonality 17B

| S. pyogenes 2nd Tier gRNA Name | DNA Strand | Targeting Domain | Target Site Length | Seq ID |
|---|---|---|---|---|
| NHEJ1-21 | + | AAUCGCGUUCGAGUCCGGGC | 20 | 786 |
| NHEJ1-22 | + | ACCCUGCCUCCUCUUGCGGU | 20 | 787 |
| NHEJ1-23 | − | ACCGAAAGGCCUAGAGUAAG | 20 | 788 |
| NHEJ1-24 | + | CAGACGCUGCGGGUUGGCCC | 20 | 789 |
| NHEJ1-25 | − | CGAGCCCUACCAUCCACGCC | 20 | 790 |
| NHEJ1-26 | + | CGCUGGCCUUUUCUCCCUGG | 20 | 791 |
| NHEJ1-27 | − | CGCUUUCCCCCCACCGCAAG | 20 | 792 |
| NHEJ1-28 | + | CGGGCAGGAAAGCGUGCGUG | 20 | 793 |
| NHEJ1-29 | + | CGUGCGUGCGGCUAAGAGAG | 20 | 794 |
| NHEJ1-30 | + | CUCCACUUACCCUGGCCACU | 20 | 795 |
| NHEJ1-31 | + | CUGCCUCCUCUUGCGGUGGG | 20 | 796 |
| NHEJ1-32 | + | CUGCGGGUUGGCCCUGGCGC | 20 | 797 |
| NHEJ1-33 | + | UAAGAGAGUGGGCGCUCUCG | 20 | 798 |
| NHEJ1-34 | − | UCGAGCCCUACCAUCCACGC | 20 | 799 |
| NHEJ1-35 | + | UCGCGGCCGCUGACGGUAGG | 20 | 800 |
| NHEJ1-36 | + | UGCUGCCCGGCGUGGAUGGU | 20 | 801 |
| NHEJ1-37 | + | UGGAGGGAGCGCGCGCUGCC | 20 | 802 |
| NHEJ1-38 | + | UGGUGCGACGAAGCCGCUGG | 20 | 803 |
| NHEJ1-39 | + | UUCGGUUUGCGCGAGCGGGC | 20 | 804 |
| NHEJ1-40 | − | UUUCCCCCACCGCAAGAGG | 20 | 805 |

Table II.17B provides exemplary targeting domains of gRNAs to be used with an eiCas9 fusion molecule (e.g., an eiCas9 fused to a transcription activator or repressor domain) to alter (e.g., activate or repress) a gene, e.g., NHEJ1 gene. The targeting domains of gRNAs were selected according to the second tier parameters. The targeting domains bind within 500 bp spanning a transcription start site (TSS), e.g., upstream or downstream of a TSS and have a high level of orthogonality. It is contemplated herein that in an embodiment the targeting domain hybridizes to the target domain through complementary base pairing. Any of the targeting domains in the table can be used with a S. pyogenes eiCas9 fusion molecule (e.g., an eiCas9 fused to a transcription activator or repressor domain) to alter (e.g., activate or repress) the NHEJ1 gene. One or more gRNA may be used to target an eiCas9 fusion molecule to a region spanning 500 bp of a transcription start site (TSS) of the NHEJ1 gene.

Table II.18A provides exemplary targeting domains of gRNAs to be used with an eiCas9 fusion molecule (e.g., an eiCas9 fused to a transcription activator or repressor domain) to alter (e.g., activate or repress) a gene, e.g., NHEJ1 gene. The targeting domains of gRNAs were selected according to the first tier parameters. The targeting domains bind within 500 bp spanning a transcription start site (TSS), e.g., upstream or downstream of a TSS, have a high level of orthogonality, start with a 5'G and PAM is NNGRRT. It is contemplated herein that in an embodiment the targeting domain hybridizes to the target domain through complementary base pairing. Any of the targeting domains in the table can be used with a S. aureus eiCas9 fusion molecule (e.g., an eiCas9 fused to a transcription activator or repressor domain) to alter (e.g., activate or repress) the NHEJ1 gene. One or more gRNA may be used to target an eiCas9 fusion molecule to a region spanning 500 bp of a transcription start site (TSS) of the NHEJ1 gene.

TABLE II.18A

Exemplary HDR-enhancing gRNAs Targeting a NHEJ1 Gene

A high level of orthogonality, starts with a G, PAM is NNGRRT
18A

| S. aureus 1st Tier gRNA Name | DNA Strand | Targeting Domain | Target Site Length | Seq ID |
|---|---|---|---|---|
| NHEJ1-41 | + | GUCCAGGGCAGGCCUCCGGGGG | 22 | 806 |

Table II.18B provides exemplary targeting domains of gRNAs to be used with an eiCas9 fusion molecule (e.g., an eiCas9 fused to a transcription activator or repressor domain) to alter (e.g., activate or repress) a gene, e.g., NHEJ1 gene. The targeting domains of gRNAs were selected according to the second tier parameters. The targeting domains bind within 500 bp spanning a transcription start site (TSS), e.g., upstream or downstream of a TSS, have a high level of orthogonality and PAM is NNGRRT. It is contemplated herein that in an embodiment the targeting domain hybridizes to the target domain through complementary base pairing. Any of the targeting domains in the table can be used with a S. aureus eiCas9 fusion molecule (e.g., an eiCas9 fused to a transcription activator or repressor domain) to alter (e.g., activate or repress) the NHEJ1 gene. One or more gRNA may be used to target an eiCas9 fusion molecule to a region spanning 500 bp of a transcription start site (TSS) of the NHEJ1 gene.

TABLE II.18B

Exemplary HDR-enhancing gRNAs Targeting a NHEJ1 Gene

A high level of orthogonality, and PAM is NNGRRT
18B

| S. aureus 2nd Tier gRNA Name | DNA Strand | Targeting Domain | Target Site Length | Seq ID |
|---|---|---|---|---|
| NHEJ1-42 | – | ACCGCAAGAGGAGGCAGGGUCU | 22 | 807 |
| NHEJ1-43 | + | AGCGAGGGGCUGCUCAGACGCU | 22 | 808 |
| NHEJ1-44 | + | AGGAAAGCGUGCGUGCGGCUAA | 22 | 809 |
| NHEJ1-45 | + | AGUCCGCUGGCUGCUGCCCGGC | 22 | 810 |
| NHEJ1-46 | – | AUGAGAGGAGCGCCCCAGUGGC | 22 | 811 |
| NHEJ1-47 | + | CCCUGGAGGGAGCGCGCGCUGC | 22 | 812 |
| NHEJ1-48 | – | CGCUCGCGCAAACCGAAAGGCC | 22 | 813 |
| NHEJ1-49 | – | CGUCGCACCAAACAGGCGACCA | 22 | 814 |
| NHEJ1-50 | + | CUGACGGUAGGUGGAAUCGCGU | 22 | 815 |
| NHEJ1-51 | + | UCUCGCGCCGCUGACGGUAGG | 22 | 816 |
| NHEJ1-52 | + | UGCCCGGCGUGGAUGGUAGGGC | 22 | 817 |
| NHEJ1-53 | – | UUCCCCCCACCGCAAGAGGAGG | 22 | 818 |

Table II.19A provides exemplary targeting domains of gRNAs to be used with an eiCas9 fusion molecule (e.g., an eiCas9 fused to a transcription activator or repressor domain) to alter (e.g., activate or repress) a gene, e.g., DCLRE1C gene. The targeting domains of gRNAs were selected according to the first tier parameters. The targeting domains bind within 500 bp spanning a transcription start site (TSS), e.g., upstream or downstream of a TSS, have a high level of orthogonality and start with a 5'G. It is contemplated herein that in an embodiment the targeting domain hybridizes to the target domain through complementary base pairing. Any of the targeting domains in the table can be used with a S. pyogenes eiCas9 fusion molecule (e.g., an eiCas9 fused to a transcription activator or repressor domain) to alter (e.g., activate or repress) the DCLRE1C gene. One or more gRNA may be used to target an eiCas9 fusion molecule to a region spanning 500 bp of a transcription start site (TSS) of the DCLRE1C gene.

TABLE II.19A

Exemplary HDR-enhancing gRNAs Targeting a DCLRE1C Gene

A high level of orthogonality, and starts with a G
19A

| S. pyogenes 1st Tier gRNA Name | DNA Strand | Targeting Domain | Target Site Length | Seq ID |
|---|---|---|---|---|
| DCLRE1C-1 | + | GAGUUCUUUCGAGGGGCAGA | 20 | 819 |
| DCLRE1C-2 | – | GCCGCGCGCUGCCUCGCCAU | 20 | 820 |
| DCLRE1C-3 | – | GCGCCGCCGAUCCCAGAGUC | 20 | 821 |
| DCLRE1C-4 | + | GCGCGGCUUCCCGGAAGUGG | 20 | 822 |
| DCLRE1C-5 | + | GCGCUAUGAGUUCUUUCGAG | 20 | 823 |
| DCLRE1C-6 | + | GCGGGCGCCUAGAACCCGAC | 20 | 824 |
| DCLRE1C-7 | + | GCUUCCCGGAAGUGGCGGCG | 20 | 825 |
| DCLRE1C-8 | + | GCUUCGAUAGGGAGAACCUG | 20 | 826 |
| DCLRE1C-9 | – | GGAAGUAGGCGCGGGCCCUC | 20 | 827 |
| DCLRE1C-10 | – | GGAGACCGGGGGCAAAGUCA | 20 | 828 |
| DCLRE1C-11 | – | GGAGCAUCCGGUCGGGUUCU | 20 | 829 |
| DCLRE1C-12 | + | GGCGCGGUCAGGGCUGGCCU | 20 | 830 |
| DCLRE1C-13 | + | GGCGCUAUGAGUUCUUUCGA | 20 | 831 |
| DCLRE1C-14 | + | GGCUGCGUUCGGCCGCCCAA | 20 | 832 |
| DCLRE1C-15 | – | GGGCAAAGUCAAGGAGCAUC | 20 | 833 |
| DCLRE1C-16 | + | GGGGUCCCGGACUCUGGGAU | 20 | 834 |
| DCLRE1C-17 | + | GGUCUCCGGACUCCUCUGAU | 20 | 835 |
| DCLRE1C-18 | + | GGUUUUGGGGUCCCGGACUC | 20 | 836 |
| DCLRE1C-19 | + | GUCCCGGACUCUGGGAUCGG | 20 | 837 |
| DCLRE1C-20 | + | GUUUUGGGGUCCCGGACUCU | 20 | 838 |

Table II.19B provides exemplary targeting domains of gRNAs to be used with an eiCas9 fusion molecule (e.g., an eiCas9 fused to a transcription activator or repressor domain) to alter (e.g., activate or repress) a gene, e.g., DCLRE1C gene. The targeting domains of gRNAs were selected according to the second tier parameters. The targeting domains bind within 500 bp spanning a transcription start site (TSS), e.g., upstream or downstream of a TSS and have a high level of orthogonality. It is contemplated herein that in an embodiment the targeting domain hybridizes to the target domain through complementary base pairing. Any of the targeting domains in the table can be used with a *S. pyogenes* eiCas9 fusion molecule (e.g., an eiCas9 fused to a transcription activator or repressor domain) to alter (e.g., activate or repress) the DCLRE1C gene. One or more gRNA may be used to target an eiCas9 fusion molecule to a region spanning 500 bp of a transcription start site (TSS) of the DCLRE1C gene.

TABLE II.19B

Exemplary HDR-enhancing gRNAs Targeting a DCLRE1C Gene

A high level of orthogonality 19B

| S. pyogenes 2nd Tier gRNA Name | DNA Strand | Targeting Domain | Target Site Length | Seq ID |
|---|---|---|---|---|
| DCLRE1C-21 | − | AAGCGGUCUAUGGAGAUAGU | 20 | 839 |
| DCLRE1C-22 | − | ACGCAGCCACGUCCAAUCAG | 20 | 840 |
| DCLRE1C-23 | + | AGCGCGCGGCUUCCCGGAAG | 20 | 841 |
| DCLRE1C-24 | − | AUCAGAGGAGUCCGGAGACC | 20 | 842 |
| DCLRE1C-25 | − | CACGUCCAAUCAGAGGAGUC | 20 | 843 |
| DCLRE1C-26 | + | CCCAAUGGCGAGGCAGCGCG | 20 | 844 |
| DCLRE1C-27 | − | CCGCGCGCUGCCUCGCCAUU | 20 | 845 |
| DCLRE1C-28 | − | CCUGACCGCGCCGCCACUUC | 20 | 846 |
| DCLRE1C-29 | − | CGCCGCCGAUCCCAGAGUCC | 20 | 847 |
| DCLRE1C-30 | + | CGGAAGUGGCGGCGCGGUCA | 20 | 848 |
| DCLRE1C-31 | + | CGGACUCCUCUGAUUGGACG | 20 | 849 |
| DCLRE1C-32 | + | CGGCGCUAUGAGUUCUUUCG | 20 | 850 |
| DCLRE1C-33 | + | CGUUCGGCCGCCCAAUGGCG | 20 | 851 |
| DCLRE1C-34 | + | CUCCAUAGACCGCUUCGAUA | 20 | 852 |
| DCLRE1C-35 | − | CUCCCUAUCGAAGCGGUCUA | 20 | 853 |
| DCLRE1C-36 | − | CUGACCGCGCCGCCACUUCC | 20 | 854 |
| DCLRE1C-37 | + | CUUCGAUAGGGAGAACCUGA | 20 | 855 |
| DCLRE1C-38 | − | UCAGAGGAGUCCGGAGACCG | 20 | 856 |
| DCLRE1C-39 | + | UCUCCAUAGACCGCUUCGAU | 20 | 857 |
| DCLRE1C-40 | + | UGAUUGGACGUGGCUGCGUU | 20 | 858 |

Table II.20A provides exemplary targeting domains of gRNAs to be used with an eiCas9 fusion molecule (e.g., an eiCas9 fused to a transcription activator or repressor domain) to alter (e.g., activate or repress) a gene, e.g., DCLRE1C gene. The targeting domains of gRNAs were selected according to the first tier parameters. The targeting domains bind within 500 bp spanning a transcription start site (TSS), e.g., upstream or downstream of a TSS, have a high level of orthogonality, start with a 5'G and PAM is NNGRRT. It is contemplated herein that in an embodiment the targeting domain hybridizes to the target domain through complementary base pairing. Any of the targeting domains in the table can be used with a *S. aureus* eiCas9 fusion molecule (e.g., an eiCas9 fused to a transcription activator or repressor domain) to alter (e.g., activate or repress) the DCLRE1C gene. One or more gRNA may be used to target an eiCas9 fusion molecule to a region spanning 500 bp of a transcription start site (TSS) of the DCLRE1C gene.

TABLE II.20A

Exemplary HDR-enhancing gRNAs Targeting a DCLRE1C Gene

A high level of orthogonality, starts with a G, PAM is NNGRRT 20A

| S. aureus 1st Tier gRNA Name | DNA Strand | Targeting Domain | Target Site Length | Seq ID |
|---|---|---|---|---|
| DCLRE1C-41 | − | GAACGCAGCCACGUCCAAUCAG | 22 | 859 |
| DCLRE1C-42 | − | GAACUCAUAGCGCCGCCGAUCC | 22 | 860 |
| DCLRE1C-43 | + | GCAGCGGGCGCCUAGAACCCGA | 22 | 861 |
| DCLRE1C-44 | + | GCCUUGGCUUCAGCUGCGGUUU | 22 | 862 |
| DCLRE1C-45 | + | GCGGUUUUGGGGUCCCGGACUC | 22 | 863 |
| DCLRE1C-46 | + | GGACUCUGGGAUCGGCGGCGCU | 22 | 864 |
| DCLRE1C-47 | − | GGCAAAGUCAAGGAGCAUCCGG | 22 | 865 |

Table II.20B provides exemplary targeting domains of gRNAs to be used with an eiCas9 fusion molecule (e.g., an eiCas9 fused to a transcription activator or repressor domain) to alter (e.g., activate or repress) a gene, e.g., DCLRE1C gene. The targeting domains of gRNAs were selected according to the second tier parameters. The targeting domains bind within 500 bp spanning a transcription start site (TSS), e.g., upstream or downstream of a TSS, have a high level of orthogonality and PAM is NNGRRT. It is contemplated herein that in an embodiment the targeting domain hybridizes to the target domain through complementary base pairing. Any of the targeting domains in the table can be used with a *S. aureus* eiCas9 fusion molecule (e.g., an eiCas9 fused to a transcription activator or repressor domain) to alter (e.g., activate or repress) the DCLRE1C gene. One or more gRNA may be used to target an eiCas9 fusion molecule to a region spanning 500 bp of a transcription start site (TSS) of the DCLRE1C gene.

TABLE II.20B

Exemplary HDR-enhancing gRNAs Targeting a DCLRE1C Gene

A high level of orthogonality, and PAM is NNGRRT 20B

| S. aureus 2nd Tier gRNA Name | DNA Strand | Targeting Domain | Target Site Length | Seq ID |
|---|---|---|---|---|
| DCLRE1C-48 | + | AGUUCUUUCGAGGGGCAGAUGG | 22 | 866 |
| DCLRE1C-49 | − | UCGAAGCGGUCUAUGGAGAUAG | 22 | 867 |

Table II.21A provides exemplary targeting domains of gRNAs to be used with an eiCas9 fusion molecule (e.g., an eiCas9 fused to a transcription activator or repressor domain) to alter (e.g., activate or repress) a gene, e.g., BRCA2 gene. The targeting domains of gRNAs were selected according to the first tier parameters. The targeting domains bind within 500 bp spanning a transcription start site (TSS), e.g., upstream or downstream of a TSS, have a high level of orthogonality and start with a 5'G. It is contemplated herein that in an embodiment the targeting domain hybridizes to the target domain through complementary base pairing. Any of the targeting domains in the table can be used with a *S. pyogenes* eiCas9 fusion molecule (e.g., an eiCas9 fused to a transcription activator or repressor domain) to alter (e.g., activate or repress) the BRCA2 gene. One or more gRNA may be used to target an eiCas9 fusion molecule to a region spanning 500 bp of a transcription start site (TSS) of the BRCA2 gene.

TABLE II.21A

Exemplary HDR-enhancing gRNAs Targeting a BRCA2 Gene

A high level of orthogonality, and starts with a G
21A

| S. pyogenes 1st Tier gRNA Name | DNA Strand | Targeting Domain | Target Site Length | Seq ID |
|---|---|---|---|---|
| BRCA2-1 | + | GACGGUUGGGAUGCCUGACA | 20 | 868 |
| BRCA2-2 | - | GAGGCGCAGCAGUGCCACAG | 20 | 869 |
| BRCA2-3 | + | GCCCACCCAGGCCUGACUUC | 20 | 870 |
| BRCA2-4 | + | GCCUCGGGUGUCUUUUGCGG | 20 | 871 |
| BRCA2-5 | - | GCGAAAGGAAAUUCCUUGUC | 20 | 872 |
| BRCA2-6 | + | GCUGCGCCUCUGCUGCGCCU | 20 | 873 |
| BRCA2-7 | - | GCUGCGGGUAUUUCUCAGUG | 20 | 874 |
| BRCA2-8 | - | GUAUUUCUCAGUGUGGCGAA | 20 | 875 |
| BRCA2-9 | + | GUGUGCUGCGUGUCGCGUCA | 20 | 876 |

TABLE II.21B

Exemplary HDR-enhancing gRNAs Targeting a BRCA2 Gene

A high level of orthogonality
21B

| S. pyogenes 2nd Tier gRNA Name | DNA Strand | Targeting Domain | Target Site Length | Seq ID |
|---|---|---|---|---|
| BRCA2-10 | - | ACACGCACCACCCGGAAGUC | 20 | 877 |
| BRCA2-11 | + | ACACUGAGAAAUACCCGCAG | 20 | 878 |
| BRCA2-12 | - | ACCACCCGGAAGUCAGGCCU | 20 | 879 |
| BRCA2-13 | + | ACCCAGGCCUGACUUCCGGG | 20 | 880 |
| BRCA2-14 | - | ACCGCCGCAAAAGACACCCG | 20 | 881 |
| BRCA2-15 | + | ACGGCGUCACGUGGCCAGCG | 20 | 882 |
| BRCA2-16 | + | ACGUGGCCAGCGCGGGCUUG | 20 | 883 |
| BRCA2-17 | + | AUACCCGCAGCGGCCCACCC | 20 | 884 |
| BRCA2-18 | - | CACCACCCGGAAGUCAGGCC | 20 | 885 |
| BRCA2-19 | - | CCCGGAAGUCAGGCCUGGGU | 20 | 886 |
| BRCA2-20 | + | CGCGAGCUUCUGAAACUAGG | 20 | 887 |
| BRCA2-21 | + | CGGCAGAGGCGGAGCCGCUG | 20 | 888 |
| BRCA2-22 | + | CGGCGUCACGUGGCCAGCGC | 20 | 889 |
| BRCA2-23 | + | CGGGUGUCUUUUGCGGCGGU | 20 | 890 |
| BRCA2-24 | - | CUCGCGCCACAAGCCCGCGC | 20 | 891 |
| BRCA2-25 | + | CUUCUGAAACUAGGCGGCAG | 20 | 892 |
| BRCA2-26 | + | UCGGGUGUCUUUUGCGGCGG | 20 | 893 |
| BRCA2-27 | + | UGCGCCUCGGGUGUCUUUUG | 20 | 894 |
| BRCA2-28 | + | UGGCGCGAGCUUCUGAAACU | 20 | 895 |
| BRCA2-29 | + | UGUCGCGUCACGGCGUCACG | 20 | 896 |

Table II.21B provides exemplary targeting domains of gRNAs to be used with an eiCas9 fusion molecule (e.g., an eiCas9 fused to a transcription activator or repressor domain) to alter (e.g., activate or repress) a gene, e.g., BRCA2 gene. The targeting domains of gRNAs were selected according to the second tier parameters. The targeting domains bind within 500 bp spanning a transcription start site (TSS), e.g., upstream or downstream of a TSS and have a high level of orthogonality. It is contemplated herein that in an embodiment the targeting domain hybridizes to the target domain through complementary base pairing. Any of the targeting domains in the table can be used with a *S. pyogenes* eiCas9 fusion molecule (e.g., an eiCas9 fused to a transcription activator or repressor domain) to alter (e.g., activate or repress) the BRCA2 gene. One or more gRNA may be used to target an eiCas9 fusion molecule to a region spanning 500 bp of a transcription start site (TSS) of the BRCA2 gene.

Table II.22A provides exemplary targeting domains of gRNAs to be used with an eiCas9 fusion molecule (e.g., an eiCas9 fused to a transcription activator or repressor domain) to alter (e.g., activate or repress) a gene, e.g., BRCA2 gene. The targeting domains of gRNAs were selected according to the first tier parameters. The targeting domains bind within 500 bp spanning a transcription start site (TSS), e.g., upstream or downstream of a TSS, have a high level of orthogonality, start with a 5'G and PAM is NNGRRT. It is contemplated herein that in an embodiment the targeting domain hybridizes to the target domain through complementary base pairing. Any of the targeting domains in the table can be used with a *S. aureus* eiCas9 fusion molecule (e.g., an eiCas9 fused to a transcription activator or repressor domain) to alter (e.g., activate or repress) the BRCA2 gene. One or more gRNA may be used to target an eiCas9 fusion molecule to a region spanning 500 bp of a transcription start site (TSS) of the BRCA2 gene.

TABLE II.22A

Exemplary HDR-enhancing gRNAs Targeting a BRCA2 Gene

A high level of orthogonality, starts with a G, PAM is NNGRRT
22A

| S. aureus 1st Tier gRNA Name | DNA Strand | Targeting Domain | Target Site Length | Seq ID |
|---|---|---|---|---|
| BRCA2-30 | + | GCCUCGGGUGUCUUUUGCGGCG | 22 | 897 |
| BRCA2-31 | + | GCGGCCCACCCAGGCCUGACUU | 22 | 898 |

Table II.22B provides exemplary targeting domains of gRNAs to be used with an eiCas9 fusion molecule (e.g., an eiCas9 fused to a transcription activator or repressor domain) to alter (e.g., activate or repress) a gene, e.g., BRCA2 gene. The targeting domains of gRNAs were selected according to the second tier parameters. The targeting domains bind within 500 bp spanning a transcription start site (TSS), e.g., upstream or downstream of a TSS, have a high level of orthogonality and PAM is NNGRRT. It is contemplated herein that in an embodiment the targeting domain hybridizes to the target domain through complementary base pairing. Any of the targeting domains in the table can be used with a S. aureus eiCas9 fusion molecule (e.g., an eiCas9 fused to a transcription activator or repressor domain) to alter (e.g., activate or repress) the BRCA2 gene. One or more gRNA may be used to target an eiCas9 fusion molecule to a region spanning 500 bp of a transcription start site (TSS) of the BRCA2 gene.

TABLE II.22B

Exemplary HDR-enhancing gRNAs Targeting a BRCA2 Gene

A high level of orthogonality, and PAM is NNGRRT
22B

| S. aureus 2nd Tier gRNA Name | DNA Strand | Targeting Domain | Target Site Length | Seq ID |
|---|---|---|---|---|
| BRCA2-32 | − | ACGCACCACCCGGAAGUCAGGC | 22 | 899 |
| BRCA2-33 | + | ACUGCUGCGCCUCUGCUGCGCC | 22 | 900 |
| BRCA2-34 | − | AGUCAGGCCUGGGUGGGCCGCU | 22 | 901 |
| BRCA2-35 | + | CUGACGGUUGGGAUGCCUGACA | 22 | 902 |

Table II.23A provides exemplary targeting domains of gRNAs to be used with an eiCas9 fusion molecule (e.g., an eiCas9 fused to a transcription activator or repressor domain) to alter (e.g., activate or repress) a gene, e.g., RAD51 gene. The targeting domains of gRNAs were selected according to the first tier parameters. The targeting domains bind within 500 bp spanning a transcription start site (TSS), e.g., upstream or downstream of a TSS, have a high level of orthogonality and start with a 5'G. It is contemplated herein that in an embodiment the targeting domain hybridizes to the target domain through complementary base pairing. Any of the targeting domains in the table can be used with a S. pyogenes eiCas9 fusion molecule (e.g., an eiCas9 fused to a transcription activator or repressor domain) to alter (e.g., activate or repress) the RAD51 gene. One or more gRNA may be used to target an eiCas9 fusion molecule to a region spanning 500 bp of a transcription start site (TSS) of the RAD51 gene.

TABLE II.23A

Exemplary HDR-enhancing gRNAs Targeting a RAD51 Gene

A high level of orthogonality, and starts with a G
23A

| S. pyogenes 1st Tier gRNA Name | DNA Strand | Targeting Domain | Target Site Length | Seq ID |
|---|---|---|---|---|
| RAD51-1 | − | GAAGCGCCGCACUCUCCUUA | 20 | 903 |
| RAD51-2 | + | GAAGGCGGAUCCGGGAGGCG | 20 | 904 |
| RAD51-3 | + | GAGAAGGCGGAUCCGGGAGG | 20 | 905 |
| RAD51-4 | + | GCAGGGCGGAAGCGGGGAGA | 20 | 906 |
| RAD51-5 | − | GCCGCACUCUCCUUAGGGCU | 20 | 907 |
| RAD51-6 | + | GCGGGAAUUCUGAAAGCCGC | 20 | 908 |
| RAD51-7 | + | GCUGGGAACUGCAACUCAUC | 20 | 909 |
| RAD51-8 | + | GCUUCCCGAGGCGUGCAGCU | 20 | 910 |
| RAD51-9 | − | GGAAGCGCCGCACUCUCCUU | 20 | 911 |
| RAD51-10 | + | GGAAUUCUGAAAGCCGCUGG | 20 | 912 |
| RAD51-11 | + | GGAGAGUGCGGCGCUUCCCG | 20 | 913 |
| RAD51-12 | + | GGCAGUCUGUAAACUCGCGC | 20 | 914 |
| RAD51-13 | + | GGGAUACGUUACGUCGACGC | 20 | 915 |
| RAD51-14 | + | GGGCGGAAGCGGGGAGAAGG | 20 | 916 |
| RAD51-15 | + | GGGCGUGACCCUGGGCGAGA | 20 | 917 |
| RAD51-16 | + | GGGGAGAAGGCGGAUCCGGG | 20 | 918 |
| RAD51-17 | + | GGGGAUACGUUACGUCGACG | 20 | 919 |
| RAD51-18 | + | GUCGACGCGGGCGUGACCCU | 20 | 920 |
| RAD51-19 | + | GUUAGCGCGCAGGGCGGAAG | 20 | 921 |

Table II.23B provides exemplary targeting domains of gRNAs to be used with an eiCas9 fusion molecule (e.g., an eiCas9 fused to a transcription activator or repressor domain) to alter (e.g., activate or repress) a gene, e.g., RAD51 gene. The targeting domains of gRNAs were selected according to the second tier parameters. The targeting domains bind within 500 bp spanning a transcription start site (TSS), e.g., upstream or downstream of a TSS and have a high level of orthogonality. It is contemplated herein that in an embodiment the targeting domain hybridizes to the target domain through complementary base pairing. Any of the targeting domains in the table can be used with a S. pyogenes eiCas9 fusion molecule (e.g., an eiCas9 fused to a transcription activator or repressor domain) to alter (e.g., activate or repress) the RAD51 gene. One or more gRNA may be used to target an eiCas9 fusion molecule to a region spanning 500 bp of a transcription start site (TSS) of the RAD51 gene.

TABLE II.23B

Exemplary HDR-enhancing gRNAs Targeting a RAD51 Gene

A high level of orthogonality
23B

| S. pyogenes 2nd Tier gRNA Name | DNA Strand | Targeting Domain | Target Site Length | Seq ID |
|---|---|---|---|---|
| RAD51-20 | + | AAGCGGGGAGAAGGCGGAUC | 20 | 922 |
| RAD51-21 | + | AAGCUCUCGAGCUCCCGUCU | 20 | 923 |
| RAD51-22 | + | AGCUCUCGAGCUCCCGUCUU | 20 | 924 |
| RAD51-23 | − | AGUUCCCAGCUGCACGCCUC | 20 | 925 |
| RAD51-24 | + | CCCGUCUUGGGUUAGCGCGC | 20 | 926 |
| RAD51-25 | − | CCCUGCGCGCUAACCCAAGA | 20 | 927 |
| RAD51-26 | − | CCGCCAAACCCUCUCGCCCA | 20 | 928 |
| RAD51-27 | + | CCGUCUUGGGUUAGCGCGCA | 20 | 929 |
| RAD51-28 | − | CCUGCGCGCUAACCCAAGAC | 20 | 930 |
| RAD51-29 | − | CGCUGCGCGCGGUCCGCCAG | 20 | 931 |
| RAD51-30 | + | CGCUGGCGGACCGCGCGCAG | 20 | 932 |
| RAD51-31 | + | CGGGCGUGACCCUGGGCGAG | 20 | 933 |
| RAD51-32 | − | CGGUCUCUGGCCGCUGCGCG | 20 | 934 |
| RAD51-33 | − | CGUAACGUAUCCCCGCCUCC | 20 | 935 |
| RAD51-34 | + | CGUCGACGCGGGCGUGACCC | 20 | 936 |
| RAD51-35 | + | UAGCGCGCAGGGCGGAAGCG | 20 | 937 |
| RAD51-36 | + | UCAUCUGGGUUGUGCGCAGA | 20 | 938 |
| RAD51-37 | + | UCUUGGGUUAGCGCGCAGGG | 20 | 939 |
| RAD51-38 | + | UGGGUUGUGCGCAGAAGGCU | 20 | 940 |
| RAD51-39 | + | UUAGCGCGCAGGGCGGAAGC | 20 | 941 |

Table II.24A provides exemplary targeting domains of gRNAs to be used with an eiCas9 fusion molecule (e.g., an eiCas9 fused to a transcription activator or repressor domain) to alter (e.g., activate or repress) a gene, e.g., RAD51 gene. The targeting domains of gRNAs were selected according to the first tier parameters. The targeting domains bind within 500 bp spanning a transcription start site (TSS), e.g., upstream or downstream of a TSS, have a high level of orthogonality, start with a 5'G and PAM is NNGRRT. It is contemplated herein that in an embodiment the targeting domain hybridizes to the target domain through complementary base pairing. Any of the targeting domains in the table can be used with a S. aureus eiCas9 fusion molecule (e.g., an eiCas9 fused to a transcription activator or repressor domain) to alter (e.g., activate or repress) the RAD51 gene. One or more gRNA may be used to target an eiCas9 fusion molecule to a region spanning 500 bp of a transcription start site (TSS) of the RAD51 gene.

TABLE II.24A

Exemplary HDR-enhancing gRNAs Targeting a RAD51 Gene

A high level of orthogonality, starts with a G, PAM is NNGRRT
24A

| S. aureus 1st Tier gRNA Name | DNA Strand | Targeting Domain | Target Site Length | Seq ID |
|---|---|---|---|---|
| RAD51-40 | − | GAGCUCGAGAGCUUGAUCCUGC | 22 | 942 |
| RAD51-41 | + | GAGGGCAGUCUGUAAACUCGCG | 22 | 943 |
| RAD51-42 | + | GCAGCUGGGAACUGCAACUCAU | 22 | 944 |
| RAD51-43 | + | GCAGGGCGGAAGCGGGGAGAAG | 22 | 945 |
| RAD51-44 | + | GGAGAAGGCGGAUCCGGAGGC | 22 | 946 |

Table II.24B provides exemplary targeting domains of gRNAs to be used with an eiCas9 fusion molecule (e.g., an eiCas9 fused to a transcription activator or repressor domain) to alter (e.g., activate or repress) a gene, e.g., RAD51 gene. The targeting domains of gRNAs were selected according to the second tier parameters. The targeting domains bind within 500 bp spanning a transcription start site (TSS), e.g., upstream or downstream of a TSS, have a high level of orthogonality and PAM is NNGRRT. It is contemplated herein that in an embodiment the targeting domain hybridizes to the target domain through complementary base pairing. Any of the targeting domains in the table can be used with a S. aureus eiCas9 fusion molecule (e.g., an eiCas9 fused to a transcription activator or repressor domain) to alter (e.g., activate or repress) the RAD51 gene. One or more gRNA may be used to target an eiCas9 fusion molecule to a region spanning 500 bp of a transcription start site (TSS) of the RAD51 gene.

TABLE II.24B

Exemplary HDR-enhancing gRNAs Targeting a RAD51 Gene

A high level of orthogonality, and PAM is NNGRRT
24B

| S. aureus 2nd Tier gRNA Name | DNA Strand | Targeting Domain | Target Site Length | Seq ID |
|---|---|---|---|---|
| RAD51-45 | + | ACCCUGGGCGAGAGGGUUUGGC | 22 | 947 |
| RAD51-46 | + | ACGCGGGCGUGACCCUGGGCGA | 22 | 948 |
| RAD51-47 | + | AUCAAGCUCUCGAGCUCCCGUC | 22 | 949 |
| RAD51-48 | − | AUUCCCGCCAAACCCUCUCGCC | 22 | 950 |
| RAD51-49 | − | CAGCCUUCUGCGCACAACCCAG | 22 | 951 |
| RAD51-50 | − | CGACGUAACGUAUCCCCGCCUC | 22 | 952 |
| RAD51-51 | − | CGCGCGGUCCGCCAGCGGCUUU | 22 | 953 |
| RAD51-52 | + | CGGCCAGAGACCGAGCCCUAAG | 22 | 954 |

Table II.25A provides exemplary targeting domains of gRNAs to be used with an eiCas9 fusion molecule (e.g., an eiCas9 fused to a transcription activator or repressor domain) to alter (e.g., activate or repress) a gene, e.g., XRCC1 gene. The targeting domains of gRNAs were selected according to the first tier parameters. The targeting domains bind within 500 bp spanning a transcription start site (TSS), e.g., upstream or downstream of a TSS, have a high level of orthogonality and start with a 5'G. It is contemplated herein that in an embodiment the targeting domain hybridizes to the target domain through complementary base pairing. Any of the targeting domains in the table can be used with a *S. pyogenes* eiCas9 fusion molecule (e.g., an eiCas9 fused to a transcription activator or repressor domain) to alter (e.g., activate or repress) the XRCC1 gene. One or more gRNA may be used to target an eiCas9 fusion molecule to a region spanning 500 bp of a transcription start site (TSS) of the XRCC1 gene.

TABLE II.25A

Exemplary HDR-enhancing gRNAs Targeting a XRCC1 Gene

A high level of orthogonality, and starts with a G
25A

| S. pyogenes 1st Tier gRNA Name | DNA Strand | Targeting Domain | Target Site Length | Seq ID |
|---|---|---|---|---|
| XRCC1-1 | − | GAAGGAUGAGGUAGAGUAUG | 20 | 955 |
| XRCC1-2 | − | GACAUGGGGUGAGAGGGCGG | 20 | 956 |
| XRCC1-3 | + | GACGCCGGCGCCGGCGCGCC | 20 | 957 |
| XRCC1-4 | − | GACGUCCGAACCCUGCUUUC | 20 | 958 |
| XRCC1-5 | − | GAGGUAGAGUAUGGGGUCCG | 20 | 959 |
| XRCC1-6 | − | GAGUAUGGGGUCCGAGGGGC | 20 | 960 |
| XRCC1-7 | + | GCGCUCUUCCCGCUCUGGAG | 20 | 961 |
| XRCC1-8 | + | GCGGGGUUGUGUGUGGCGGA | 20 | 962 |
| XRCC1-9 | + | GGAGGAAACGCUCGUUGCUA | 20 | 963 |
| XRCC1-10 | + | GGCUAGAGCGGGGUUGUGUG | 20 | 964 |
| XRCC1-11 | + | GGCUCCCAGAAAGCAGGGUU | 20 | 965 |
| XRCC1-12 | − | GGCUCGGGCCUUUCAAACCC | 20 | 966 |
| XRCC1-13 | + | GGCUUGCGCAGUGUCGACGC | 20 | 967 |
| XRCC1-14 | − | GGGCGGGGUGCGCCCUGCGC | 20 | 968 |
| XRCC1-15 | + | GGGUUGUGUGUGGCGGAGGG | 20 | 969 |
| XRCC1-16 | − | GGUAGAGUAUGGGGUCCGAG | 20 | 970 |
| XRCC1-17 | − | GGUCCGAGGGGCAGGGAGAG | 20 | 971 |
| XRCC1-18 | − | GUCCGAGGGGCAGGGAGAGU | 20 | 972 |
| XRCC1-19 | − | GUGCGCAAGCGCGCGAGGCU | 20 | 973 |
| XRCC1-20 | − | GUGGGCUUCGCCUGGCCAGA | 20 | 974 |

Table II.25B provides exemplary targeting domains of gRNAs to be used with an eiCas9 fusion molecule (e.g., an eiCas9 fused to a transcription activator or repressor domain) to alter (e.g., activate or repress) a gene, e.g., XRCC1 gene. The targeting domains of gRNAs were selected according to the second tier parameters. The targeting domains bind within 500 bp spanning a transcription start site (TSS), e.g., upstream or downstream of a TSS and have a high level of orthogonality. It is contemplated herein that in an embodiment the targeting domain hybridizes to the target domain through complementary base pairing. Any of the targeting domains in the table can be used with a *S. pyogenes* eiCas9 fusion molecule (e.g., an eiCas9 fused to a transcription activator or repressor domain) to alter (e.g., activate or repress) the XRCC1 gene. One or more gRNA may be used to target an eiCas9 fusion molecule to a region spanning 500 bp of a transcription start site (TSS) of the XRCC1 gene.

TABLE II.25B

Exemplary HDR-enhancing gRNAs Targeting a XRCC1 Gene

A high level of orthogonality
25B

| S. pyogenes 2nd Tier gRNA Name | DNA Strand | Targeting Domain | Target Site Length | Seq ID |
|---|---|---|---|---|
| XRCC1-21 | + | AAGCAGGGUUCGGACGUCAU | 20 | 975 |
| XRCC1-22 | − | ACAUGGCGGAGGCGGAUCUC | 20 | 976 |
| XRCC1-23 | + | ACGCAGCGCUCUUCCCGCUC | 20 | 977 |
| XRCC1-24 | − | ACGUCCGAACCCUGCUUUCU | 20 | 978 |
| XRCC1-25 | + | ACUCCAUCGUGCAAUGAGAA | 20 | 979 |
| XRCC1-26 | + | AGCAGGGUUCGGACGUCAUU | 20 | 980 |
| XRCC1-27 | + | AGGGUUCGGACGUCAUUGGG | 20 | 981 |
| XRCC1-28 | − | CAGUCGCGCCUCUCCAGAGC | 20 | 982 |
| XRCC1-29 | + | CCGCUCUGGAGAGGCGCGAC | 20 | 983 |
| XRCC1-30 | + | CCGGCGCGCCGGGGUUUGAA | 20 | 984 |
| XRCC1-31 | − | CCUUUCAAACCCCGGCGCGC | 20 | 985 |
| XRCC1-32 | − | CGACCUCCGGGAUUGGUGUC | 20 | 986 |
| XRCC1-33 | + | CGCUCUGGAGAGGCGCGACU | 20 | 987 |
| XRCC1-34 | − | CUCCGGCAUGUCAACGUCGU | 20 | 988 |
| XRCC1-35 | − | UCAACGUCGUGGGCUUCGCC | 20 | 989 |
| XRCC1-36 | + | UCGGACGUCAUUGGGAGGCG | 20 | 990 |
| XRCC1-37 | − | UCUCCGGCAUGUCAACGUCG | 20 | 991 |
| XRCC1-38 | − | UGCGCAAGCGCGCGAGGCUC | 20 | 992 |
| XRCC1-39 | + | UGCGCACUUUAGCCAGCGCA | 20 | 993 |
| XRCC1-40 | + | UUGCGCACUUUAGCCAGCGC | 20 | 994 |

Table II.26A provides exemplary targeting domains of gRNAs to be used with an eiCas9 fusion molecule (e.g., an eiCas9 fused to a transcription activator or repressor domain) to alter (e.g., activate or repress) a gene, e.g., XRCC1 gene. The targeting domains of gRNAs were selected according to the first tier parameters. The targeting domains bind within 500 bp spanning a transcription start site (TSS), e.g., upstream or downstream of a TSS, have a high level of orthogonality, start with a 5'G and PAM is NNGRRT. It is contemplated herein that in an embodiment the targeting domain hybridizes to the target domain through complementary base pairing. Any of the targeting domains in the table can be used with a *S. aureus* eiCas9 fusion molecule (e.g., an eiCas9 fused to a transcription activator or repressor domain) to alter (e.g., activate or repress) the XRCC1 gene. One or more gRNA may be used to target an eiCas9 fusion molecule to a region spanning 500 bp of a transcription start site (TSS) of the XRCC1 gene.

TABLE II.26A

Exemplary HDR-enhancing gRNAs Targeting a XRCC1 Gene

A high level of orthogonality, starts with a G, PAM is NNGRRT 26A

| S. aureus 1st Tier gRNA Name | DNA Strand | Targeting Domain | Target Site Length | Seq ID |
|---|---|---|---|---|
| XRCC1-41 | − | GACAGGGUCUUGCUCUCUCACC | 22 | 995 |
| XRCC1-42 | + | GAUCGUGCCACUGCACUCCAUC | 22 | 996 |
| XRCC1-43 | − | GCCAGAAGGAUGAGGUAGAGUA | 22 | 997 |
| XRCC1-44 | − | GCCUAGCAACAGAAGCGACCUC | 22 | 998 |
| XRCC1-45 | + | GCUACUUAGGAGGCUGAAGUGG | 22 | 999 |
| XRCC1-46 | + | GGAUCCCUUGGCCCCAGGAGAC | 22 | 1000 |
| XRCC1-47 | − | GGGCAGGGAGAGUGGGAGGGGG | 22 | 1001 |
| XRCC1-48 | − | GGUCUUGCUCUCUCACCCAGGA | 22 | 1002 |
| XRCC1-49 | + | GUCGACGCCGGCGCCGGCGCGC | 22 | 1003 |
| XRCC1-50 | − | GUCGUGGGCUUCGCCUGGCCAG | 22 | 1004 |

Table II.26B provides exemplary targeting domains of gRNAs to be used with an eiCas9 fusion molecule (e.g., an eiCas9 fused to a transcription activator or repressor domain) to alter (e.g., activate or repress) a gene, e.g., XRCC1 gene. The targeting domains of gRNAs were selected according to the second tier parameters. The targeting domains bind within 500 bp spanning a transcription start site (TSS), e.g., upstream or downstream of a TSS, have a high level of orthogonality and PAM is NNGRRT. It is contemplated herein that in an embodiment the targeting domain hybridizes to the target domain through complementary base pairing. Any of the targeting domains in the table can be used with a S. aureus eiCas9 fusion molecule (e.g., an eiCas9 fused to a transcription activator or repressor domain) to alter (e.g., activate or repress) the XRCC1 gene. One or more gRNA may be used to target an eiCas9 fusion molecule to a region spanning 500 bp of a transcription start site (TSS) of the XRCC1 gene.

TABLE II.26B

Exemplary HDR-enhancing gRNAs Targeting a XRCC1 Gene

A high level of orthogonality, and PAM is NNGRRT 26B

| S. aureus 2nd Tier gRNA Name | DNA Strand | Targeting Domain | Target Site Length | Seq ID |
|---|---|---|---|---|
| XRCC1-51 | + | ACUCCAUCGUGCAAUGAGAAAG | 22 | 1005 |
| XRCC1-52 | − | AGUAUGGGGUCCGAGGGGCAGG | 22 | 1006 |

TABLE II.26B-continued

Exemplary HDR-enhancing gRNAs Targeting a XRCC1 Gene

A high level of orthogonality, and PAM is NNGRRT 26B

| S. aureus 2nd Tier gRNA Name | DNA Strand | Targeting Domain | Target Site Length | Seq ID |
|---|---|---|---|---|
| XRCC1-53 | − | AUUCGCCUUUCUCAUUGCACGA | 22 | 1007 |
| XRCC1-54 | − | CAACCCCUGUCUCCUGGGGCCA | 22 | 1008 |
| XRCC1-55 | + | CCACAAAAAAUACAAAAAUUAG | 22 | 1009 |
| XRCC1-56 | − | CCACUUCAGCCUCCUAAGUAGC | 22 | 1010 |
| XRCC1-57 | + | CUGUUGCUAGGCUCCCAGAAAG | 22 | 1011 |
| XRCC1-58 | + | UCAUUGGGAGGCGAGGCUAGAG | 22 | 1012 |
| XRCC1-59 | − | UCGCCUGGCCAGAAGGAUGAGG | 22 | 1013 |
| XRCC1-60 | − | UUUUAAAAAUUUUUUGUUGAGA | 22 | 1014 |
| XRCC1-61 | − | UUUUGUAUUUUUUGUGGAGACA | 22 | 1015 |

Table II.27A provides exemplary targeting domains of gRNAs to be used with an eiCas9 fusion molecule (e.g., an eiCas9 fused to a transcription activator or repressor domain) to alter (e.g., activate or repress) a gene, e.g., LIG1 gene. The targeting domains of gRNAs were selected according to the first tier parameters. The targeting domains bind within 500 bp spanning a transcription start site (TSS), e.g., upstream or downstream of a TSS, have a high level of orthogonality and start with a 5'G. It is contemplated herein that in an embodiment the targeting domain hybridizes to the target domain through complementary base pairing. Any of the targeting domains in the table can be used with a S. pyogenes eiCas9 fusion molecule (e.g., an eiCas9 fused to a transcription activator or repressor domain) to alter (e.g., activate or repress) the LIG1 gene. One or more gRNA may be used to target an eiCas9 fusion molecule to a region spanning 500 bp of a transcription start site (TSS) of the LIG1 gene.

TABLE II.27A

Exemplary HDR-enhancing gRNAs Targeting a LIG1 Gene

A high level of orthogonality, and starts with a G 27A

| S. pyogenes 1st Tier gRNA Name | DNA Strand | Targeting Domain | Target Site Length | Seq ID |
|---|---|---|---|---|
| LIG1-1 | − | GACGUCUGCGGGCGGGGCG | 20 | 1016 |
| LIG1-2 | + | GACUGCAGAGGCGCGCCUGG | 20 | 1017 |
| LIG1-3 | − | GCAACACACUCAGAUCCGCC | 20 | 1018 |
| LIG1-4 | − | GCAGUCCCAAGUUCGCGCCA | 20 | 1019 |
| LIG1-5 | − | GCCCGCGCUUUCCCUCGCCC | 20 | 1020 |
| LIG1-6 | − | GCCGUCGCGCGGAGGACACU | 20 | 1021 |
| LIG1-7 | + | GCCUAUGCUUCGCCAUGUCG | 20 | 1022 |

TABLE II.27A-continued

Exemplary HDR-enhancing gRNAs Targeting a LIG1 Gene

A high level of orthogonality, and starts with a G
27A

| S. pyogenes 1st Tier gRNA Name | DNA Strand | Targeting Domain | Target Site Length | Seq ID |
|---|---|---|---|---|
| LIG1-8 | + | GCGCGAACUUGGGACUGCAG | 20 | 1023 |
| LIG1-9 | − | GCGCGCAGACGUCUGCGGGC | 20 | 1024 |
| LIG1-10 | − | GCGGGGCAUCCCGGGAGCAA | 20 | 1025 |
| LIG1-11 | − | GGAGACCGCGCGGGGCAUCC | 20 | 1026 |
| LIG1-12 | − | GGAGUCGUAGUCUCCCGAAU | 20 | 1027 |
| LIG1-13 | + | GGCCUAUGCUUCGCCAUGUC | 20 | 1028 |
| LIG1-14 | + | GGCGGGUGCGCCGAAUGCUU | 20 | 1029 |
| LIG1-15 | + | GGGACCAACGCAAGGCAAGU | 20 | 1030 |
| LIG1-16 | − | GGGAGUCGUAGUCUCCCGAA | 20 | 1031 |
| LIG1-17 | + | GGGCCUAUGCUUCGCCAUGU | 20 | 1032 |
| LIG1-18 | + | GGGGCCGUCCGCAAGCAGAU | 20 | 1033 |
| LIG1-19 | − | GGUCUGAGGAGUGACUGGCA | 20 | 1034 |
| LIG1-20 | − | GUCGUAGUCUCCCGAAUGGG | 20 | 1035 |

Table II.27B provides exemplary targeting domains of gRNAs to be used with an eiCas9 fusion molecule (e.g., an eiCas9 fused to a transcription activator or repressor domain) to alter (e.g., activate or repress) a gene, e.g., LIG1 gene. The targeting domains of gRNAs were selected according to the second tier parameters. The targeting domains bind within 500 bp spanning a transcription start site (TSS), e.g., upstream or downstream of a TSS and have a high level of orthogonality. It is contemplated herein that in an embodiment the targeting domain hybridizes to the target domain through complementary base pairing. Any of the targeting domains in the table can be used with a S. pyogenes eiCas9 fusion molecule (e.g., an eiCas9 fused to a transcription activator or repressor domain) to alter (e.g., activate or repress) the LIG1 gene. One or more gRNA may be used to target an eiCas9 fusion molecule to a region spanning 500 bp of a transcription start site (TSS) of the LIG1 gene.

TABLE II.27B

Exemplary HDR-enhancing gRNAs Targeting a LIG1 Gene

A high level of orthogonality
27B

| S. pyogenes 2nd Tier gRNA Name | DNA Strand | Targeting Domain | Target Site Length | Seq ID |
|---|---|---|---|---|
| LIG1-21 | + | ACACCCGCUCAUCCAGGGCG | 20 | 1036 |
| LIG1-22 | + | ACGUCUGCGCGCGAAUGCCG | 20 | 1037 |
| LIG1-23 | − | AUUCGCGCGCAGACGUCUGC | 20 | 1038 |
| LIG1-24 | + | CACCCGCUCAUCCAGGGCGA | 20 | 1039 |
| LIG1-25 | + | CAGUGUCCUCCGCGCGACGG | 20 | 1040 |
| LIG1-26 | − | CAUUCGCGCGCAGACGUCUG | 20 | 1041 |
| LIG1-27 | − | CGCCGUCGCGCGGAGGACAC | 20 | 1042 |
| LIG1-28 | − | CGCGCGCAGACGUCUGCGGG | 20 | 1043 |
| LIG1-29 | + | CGGCGCGCGGGACCAACGCA | 20 | 1044 |
| LIG1-30 | + | CGGCGGGUGCGCCGAAUGCU | 20 | 1045 |
| LIG1-31 | + | CGGCGGUGCGGACGGUGCCC | 20 | 1046 |
| LIG1-32 | + | CGGGACCAACGCAAGGCAAG | 20 | 1047 |
| LIG1-33 | + | UCCCAGUGUCCUCCGCGCGA | 20 | 1048 |
| LIG1-34 | + | UCCGCGCGACGGCGGCGGUG | 20 | 1049 |
| LIG1-35 | − | UCGCCCUGGAUGAGCGGGUG | 20 | 1050 |
| LIG1-36 | − | UCGGUGGAAGCGCCCCCGCG | 20 | 1051 |
| LIG1-37 | + | UCUCUUCCCGCCGUGCCUCG | 20 | 1052 |
| LIG1-38 | + | UCUUCCCGCCGUGCCUCGCG | 20 | 1053 |
| LIG1-39 | + | UGUCCUCCGCGCGACGGCGG | 20 | 1054 |
| LIG1-40 | − | UUCCCUCGCCCUGGAUGAGC | 20 | 1055 |

Table II.28A provides exemplary targeting domains of gRNAs to be used with an eiCas9 fusion molecule (e.g., an eiCas9 fused to a transcription activator or repressor domain) to alter (e.g., activate or repress) a gene, e.g., LIG1 gene. The targeting domains of gRNAs were selected according to the first tier parameters. The targeting domains bind within 500 bp spanning a transcription start site (TSS), e.g., upstream or downstream of a TSS, have a high level of orthogonality, start with a 5'G and PAM is NNGRRT. It is contemplated herein that in an embodiment the targeting domain hybridizes to the target domain through complementary base pairing. Any of the targeting domains in the table can be used with a S. *aureus* eiCas9 fusion molecule (e.g., an eiCas9 fused to a transcription activator or repressor domain) to alter (e.g., activate or repress) the LIG1 gene. One or more gRNA may be used to target an eiCas9 fusion molecule to a region spanning 500 bp of a transcription start site (TSS) of the LIG1 gene.

TABLE II.28A

Exemplary HDR-enhancing gRNAs Targeting a LIG1 Gene

A high level of orthogonality, starts with a G, PAM is NNGRRT 28A

| S. aureus 1st Tier gRNA Name | DNA Strand | Targeting Domain | Target Site Length | Seq ID |
|---|---|---|---|---|
| LIG1-41 | + | GAGGCGGAGGGCGGCGGGUGCG | 22 | 1056 |
| LIG1-42 | − | GAGUGACUGGCAGGGAAAGAGG | 22 | 1057 |

TABLE II.28A-continued

Exemplary HDR-enhancing gRNAs Targeting a LIG1 Gene

A high level of orthogonality, starts with a G, PAM is NNGRRT 28A

| S. aureus 1st Tier gRNA Name | DNA Strand | Targeting Domain | Target Site Length | Seq ID |
|---|---|---|---|---|
| LIG1-43 | − | GGACACUGGGAGUCGUAGUCUC | 22 | 1058 |
| LIG1-44 | + | GGCCUGGCCCGGCCCUUGCUCC | 22 | 1059 |

Table II.28B provides exemplary targeting domains of gRNAs to be used with an eiCas9 fusion molecule (e.g., an eiCas9 fused to a transcription activator or repressor domain) to alter (e.g., activate or repress) a gene, e.g., LIG1 gene. The targeting domains of gRNAs were selected according to the second tier parameters. The targeting domains bind within 500 bp spanning a transcription start site (TSS), e.g., upstream or downstream of a TSS, have a high level of orthogonality and PAM is NNGRRT. It is contemplated herein that in an embodiment the targeting domain hybridizes to the target domain through complementary base pairing. Any of the targeting domains in the table can be used with a S. *aureus* eiCas9 fusion molecule (e.g., an eiCas9 fused to a transcription activator or repressor domain) to alter (e.g., activate or repress) the LIG1 gene. One or more gRNA may be used to target an eiCas9 fusion molecule to a region spanning 500 bp of a transcription start site (TSS) of the LIG1 gene.

TABLE II.27B

Exemplary HDR-enhancing gRNAs Targeting a LIG1 Gene

S. *aureus* A high level of orthogonality, and PAM is NNGRRT 2nd Tier 28B

| gRNA Name | DNA Strand | Targeting Domain | Target Site Length | Seq ID |
|---|---|---|---|---|
| LIG1-45 | − | AAUGCCCGCGCUUUCCCUCGCC | 22 | 1060 |
| LIG1-46 | + | AGCAGAUGGGAGGCGGAGGGCG | 22 | 1061 |
| LIG1-47 | − | AGCGGGUGUGGCUGAGGGUCUG | 22 | 1062 |
| LIG1-48 | + | CCCCGCCCGCAGACGUCUGCGC | 22 | 1063 |
| LIG1-49 | − | CCCUGGAUGAGCGGGUGUGGCU | 22 | 1064 |
| LIG1-50 | − | CCGCCGUCGCGCGGAGGACACU | 22 | 1065 |
| LIG1-51 | − | CGAAUGGGAGGAGGGCGGGAAA | 22 | 1066 |
| LIG1-52 | + | CGCCAUGUCGGGGUGUCUGCAG | 22 | 1067 |
| LIG1-53 | − | CGCUUUCCCUCGCCCUGGAUGA | 22 | 1068 |
| LIG1-54 | + | UGCAGAGGCGCGCCUGGCGGAU | 22 | 1069 |
| LIG1-55 | + | UGGGACUGCAGAGGCGCGCCUG | 22 | 1070 |
| LIG1-56 | + | UGGGGCCUAUGCUUCGCCAUGU | 22 | 1071 |

Table II.29A provides exemplary targeting domains of gRNAs to be used with an eiCas9 fusion molecule (e.g., an eiCas9 fused to a transcription activator or repressor domain) to alter (e.g., activate or repress) a gene, e.g., LIG3 gene. The targeting domains of gRNAs were selected according to the first tier parameters. The targeting domains bind within 500 bp spanning a transcription start site (TSS), e.g., upstream or downstream of a TSS, have a high level of orthogonality and start with a 5'G. It is contemplated herein that in an embodiment the targeting domain hybridizes to the target domain through complementary base pairing. Any of the targeting domains in the table can be used with a *S. pyogenes* eiCas9 fusion molecule (e.g., an eiCas9 fused to a transcription activator or repressor domain) to alter (e.g., activate or repress) the LIG3 gene. One or more gRNA may be used to target an eiCas9 fusion molecule to a region spanning 500 bp of a transcription start site (TSS) of the LIG3 gene.

TABLE II.29A

Exemplary HDR-enhancing gRNAs Targeting a LIG3 Gene

*S. pyogenes* A high level of orthogonality, and starts with a G
1st Tier 29A

| gRNA Name | DNA Strand | Targeting Domain | Target Site Length | Seq ID |
|---|---|---|---|---|
| LIG3-1 | + | GAAUGCAACUACGACCCACG | 20 | 1072 |
| LIG3-2 | + | GACAGGCGCUCCAACCGUCG | 20 | 1073 |
| LIG3-3 | + | GAGCCGGAGAGGCAGGUGAG | 20 | 1074 |
| LIG3-4 | + | GAGGCAGGUGAGGGCUACG | 20 | 1075 |
| LIG3-5 | − | GCGCCUGUCUCUUUAAAUCC | 20 | 1076 |
| LIG3-6 | − | GCGCGCAGGCGCAAGAGCCA | 20 | 1077 |
| LIG3-7 | + | GGACCCGGAUUUAAAGAGAC | 20 | 1078 |
| LIG3-8 | + | GGAGCCGGAGAGGCAGGUGA | 20 | 1079 |
| LIG3-9 | + | GGGGACCGGUCGCGUGGCCG | 20 | 1080 |
| LIG3-10 | + | GGGGGCGGGGACCGGUCGCG | 20 | 1081 |
| LIG3-11 | + | GGUGAGCGCCGGAGCCGGAG | 20 | 1082 |

Table II.29B provides exemplary targeting domains of gRNAs to be used with an eiCas9 fusion molecule (e.g., an eiCas9 fused to a transcription activator or repressor domain) to alter (e.g., activate or repress) a gene, e.g., LIG3 gene. The targeting domains of gRNAs were selected according to the second tier parameters. The targeting domains bind within 500 bp spanning a transcription start site (TSS), e.g., upstream or downstream of a TSS and have a high level of orthogonality. It is contemplated herein that in an embodiment the targeting domain hybridizes to the target domain through complementary base pairing. Any of the targeting domains in the table can be used with a *S. pyogenes* eiCas9 fusion molecule (e.g., an eiCas9 fused to a transcription activator or repressor domain) to alter (e.g., activate or repress) the LIG3 gene. One or more gRNA may be used to target an eiCas9 fusion molecule to a region spanning 500 bp of a transcription start site (TSS) of the LIG3 gene.

TABLE II.29B

Exemplary HDR-enhancing gRNAs Targeting a LIG3 Gene

*S. pyogenes* A high level of orthogonality
2nd Tier 29B

| gRNA Name | DNA Strand | Targeting Domain | Target Site Length | Seq ID |
|---|---|---|---|---|
| LIG3-12 | − | AACUUGCUCAUUACAGGCCG | 20 | 1083 |
| LIG3-13 | − | AAUCCGGGUCCUAGAGCGGG | 20 | 1084 |
| LIG3-14 | + | ACAGGCGCUCCAACCGUCGU | 20 | 1085 |

TABLE II.29B-continued

Exemplary HDR-enhancing gRNAs Targeting a LIG3 Gene

*S. pyogenes* A high level of orthogonality
2nd Tier 29B

| gRNA Name | DNA Strand | Targeting Domain | Target Site Length | Seq ID |
|---|---|---|---|---|
| LIG3-15 | + | ACUACGACCCACGUGGCAGA | 20 | 1086 |
| LIG3-16 | − | ACUUGCUCAUUACAGGCCGC | 20 | 1087 |
| LIG3-17 | + | CAACCGUCGUGGGCUGCCCG | 20 | 1088 |
| LIG3-18 | − | CAAGGCCGCGGCCACGCGAC | 20 | 1089 |
| LIG3-19 | − | CCGGCGCUCACCGUAGGCCU | 20 | 1090 |
| LIG3-20 | − | CCGGCUCCGGCGCUCACCGU | 20 | 1091 |
| LIG3-21 | + | CCUACGGUGAGCGCCGGAGC | 20 | 1092 |
| LIG3-22 | − | CCUCGGAACUUGCUCAUUAC | 20 | 1093 |
| LIG3-23 | + | CCUGUAAUGAGCAAGUUCCG | 20 | 1094 |
| LIG3-24 | − | CGCGGGCAGCCCACGACGGU | 20 | 1095 |
| LIG3-25 | + | CGGUCGCGUGGCCGCGGCCU | 20 | 1096 |
| LIG3-26 | + | CUACGACCCACGUGGCAGAC | 20 | 1097 |
| LIG3-27 | + | UACGACCCACGUGGCAGACG | 20 | 1098 |
| LIG3-28 | − | UAGAGCGGGAGGCAGCGCGC | 20 | 1099 |
| LIG3-29 | + | UGAGCAAGUUCCGAGGCCUA | 20 | 1100 |
| LIG3-30 | − | UUAAAUCCGGGUCCUAGAGC | 20 | 1101 |
| LIG3-31 | − | UUUAAAUCCGGGUCCUAGAG | 20 | 1102 |

Table II.30A provides exemplary targeting domains of gRNAs to be used with an eiCas9 fusion molecule (e.g., an eiCas9 fused to a transcription activator or repressor domain) to alter (e.g., activate or repress) a gene, e.g., LIG3 domain) to alter (e.g., activate or repress) the LIG3 gene. One or more gRNA may be used to target an eiCas9 fusion molecule to a region spanning 500 bp of a transcription start site (TSS) of the LIG3 gene.

TABLE II.30A

Exemplary HDR-enhancing gRNAs Targeting a LIG3 Gene

*S. aureus* A high level of orthogonality, starts with a G, PAM is NNGRRT
1st Tier 30A

| gRNA Name | DNA Strand | Targeting Domain | Target Site Length | Seq ID |
|---|---|---|---|---|
| LIG3-32 | + | GCGCUGCCUCCCGCUCUAGGAC | 22 | 1103 |
| LIG3-33 | − | GGUCCCCGCCCCCGUCUGCCAC | 22 | 1104 | gene. The targeting domains of gRNAs were selected according to the first tier parameters. The targeting domains bind within 500 bp spanning a transcription start site (TSS), e.g., upstream or downstream of a TSS, have a high level of orthogonality, start with a 5'G and PAM is NNGRRT. It is contemplated herein that in an embodiment the targeting domain hybridizes to the target domain through complementary base pairing. Any of the targeting domains in the table can be used with a S. *aureus* eiCas9 fusion molecule (e.g., an eiCas9 fused to a transcription activator or repressor Table II.30B provides exemplary targeting domains of gRNAs to be used with an eiCas9 fusion molecule (e.g., an eiCas9 fused to a transcription activator or repressor domain) to alter (e.g., activate or repress) a gene, e.g., LIG3 gene. The targeting domains of gRNAs were selected according to the second tier parameters. The targeting domains bind within 500 bp spanning a transcription start site (TSS), e.g., upstream or downstream of a TSS, have a high level of orthogonality and PAM is NNGRRT. It is contemplated herein that in an embodiment the targeting-domain hybridizes to the target domain through complementary base pairing. Any of the targeting domains in the table can be used with a *S. aureus* eiCas9 fusion molecule (e.g., an eiCas9 fused to a transcription activator or repressor domain) to alter (e.g., activate or repress) the LIG3 gene. One or more gRNA may be used to target an eiCas9 fusion molecule to a region spanning 500 bp of a transcription start site (TSS) of the LIG3 gene.

TABLE II.30B

Exemplary HDR-enhancing gRNAs Targeting a LIG3 Gene

*S. aureus* A high level of orthogonality, and PAM is NNGRRT
2nd Tier 30B

| gRNA Name | DNA Strand | Targeting Domain | Target Site Length | Seq ID |
|---|---|---|---|---|
| LIG3-34 | + | CUCCCAAACAUCACAGGGCAGG | 22 | 1105 |
| LIG3-35 | − | UGGAGCGCCUGUCUCUUUAAAU | 22 | 1106 |
| LIG3-36 | − | UUCUGCCUGCCCUGUGAUGUUU | 22 | 1107 |

Table II.31A provides exemplary targeting domains of gRNAs to be used with an eiCas9 fusion molecule (e.g., an eiCas9 fused to a transcription activator or repressor domain) to alter (e.g., activate or repress) a gene, e.g., POLQ gene. The targeting domains of gRNAs were selected according to the first tier parameters. The targeting domains bind within 500 bp spanning a transcription start site (TSS), e.g., upstream or downstream of a TSS, have a high level of orthogonality and start with a 5'G. It is contemplated herein that in an embodiment the targeting domain hybridizes to the target domain through complementary base pairing. Any of the targeting domains in the table can be used with a *S. pyogenes* eiCas9 fusion molecule (e.g., an eiCas9 fused to a transcription activator or repressor domain) to alter (e.g., activate or repress) the POLQ gene. One or more gRNA may be used to target an eiCas9 fusion molecule to a region spanning 500 bp of a transcription start site (TSS) of the POLQ gene.

TABLE II.31A

Exemplary HDR-enhancing gRNAs Targeting a POLQ Gene

*S. pyogenes* A high level of orthogonality, and starts with a G
1st Tier 31A

| gRNA Name | DNA Strand | Targeting Domain | Target Site Length | Seq ID |
|---|---|---|---|---|
| POLQ-1 | + | GAACUCUAUGGUUCCGGGGC | 20 | 1108 |
| POLQ-2 | + | GAGGGAGGACGCUGGGACUG | 20 | 1109 |
| POLQ-3 | + | GCUCCUUCCCCACGAGUCUA | 20 | 1110 |
| POLQ-4 | + | GGACUGUGGCUUGCCCUGAU | 20 | 1111 |
| POLQ-5 | + | GGAGGUUUGAGUUUGAAGAC | 20 | 1112 |
| POLQ-6 | − | GGGGAAGGAGCGGCUCUCGC | 20 | 1113 |
| POLQ-7 | + | GGUUUGAGUUUGAAGACUGG | 20 | 1114 |
| POLQ-8 | − | GUCCCAGCGUCCUCCCUCUC | 20 | 1115 |
| POLQ-9 | − | GUCUUCAAACUCAAACCUCC | 20 | 1116 |
| POLQ-10 | + | GUUUGAGUUUGAAGACUGGC | 20 | 1117 |

Table II.31B provides exemplary targeting domains of gRNAs to be used with an eiCas9 fusion molecule (e.g., an eiCas9 fused to a transcription activator or repressor domain) to alter (e.g., activate or repress) a gene, e.g., POLQ gene. The targeting domains of gRNAs were selected according to the second tier parameters. The targeting domains bind within 500 bp spanning a transcription start site (TSS), e.g., upstream or downstream of a TSS and have a high level of orthogonality. It is contemplated herein that in an embodiment the targeting domain hybridizes to the target domain through complementary base pairing. Any of the targeting domains in the table can be used with a *S. pyogenes* eiCas9 fusion molecule (e.g., an eiCas9 fused to a transcription activator or repressor domain) to alter (e.g., activate or repress) the POLQ gene. One or more gRNA may be used to target an eiCas9 fusion molecule to a region spanning 500 bp of a transcription start site (TSS) of the POLQ gene.

Table II.32A provides exemplary targeting domains of gRNAs to be used with an eiCas9 fusion molecule (e.g., an eiCas9 fused to a transcription activator or repressor domain) to alter (e.g., activate or repress) a gene, e.g., POLQ gene. The targeting domains of gRNAs were selected according to the first tier parameters. The targeting domains bind within 500 bp spanning a transcription start site (TSS), e.g., upstream or downstream of a TSS, have a high level of orthogonality, start with a 5'G and PAM is NNGRRT. It is contemplated herein that in an embodiment the targeting domain hybridizes to the target domain through complementary base pairing. Any of the targeting domains in the table can be used with a S. *aureus* eiCas9 fusion molecule (e.g., an eiCas9 fused to a transcription activator or repressor domain) to alter (e.g., activate or repress) the POLQ gene. One or more gRNA may be used to target an eiCas9 fusion molecule to a region spanning 500 bp of a transcription start site (TSS) of the POLQ gene.

TABLE II.31B

Exemplary HDR-enhancing gRNAs Targeting a POLQ Gene

*S. pyogenes* A high level of orthogonality
2nd Tier 31B

| gRNA Name | DNA Strand | Targeting Domain | Target Site Length | Seq ID |
|---|---|---|---|---|
| POLQ-11 | − | AAGCCAUAGACUCGUGGGGA | 20 | 1118 |
| POLQ-12 | − | ACCCGAAAGCCAUAGACUCG | 20 | 1119 |
| POLQ-13 | + | AGAACUCUAUGGUUCCGGGG | 20 | 1120 |
| POLQ-14 | + | AGGCCAGGGUUCUCCCGAGA | 20 | 1121 |
| POLQ-15 | + | CACGGAGAACUCUAUGGUUC | 20 | 1122 |
| POLQ-16 | + | CAGGCCAGGGUUCUCCCGAG | 20 | 1123 |
| POLQ-17 | + | CCAGGGUUCUCCCGAGAGGG | 20 | 1124 |
| POLQ-18 | + | CCCACGAGUCUAUGGCUUUC | 20 | 1125 |
| POLQ-19 | + | CCCCACGAGUCUAUGGCUUU | 20 | 1126 |
| POLQ-20 | − | CCCGAAAGCCAUAGACUCGU | 20 | 1127 |
| POLQ-21 | − | CCGAAAGCCAUAGACUCGUG | 20 | 1128 |
| POLQ-22 | − | CGGAACCAUAGAGUUCUCCG | 20 | 1129 |
| POLQ-23 | + | CGGAGAACUCUAUGGUUCCG | 20 | 1130 |
| POLQ-24 | + | CUAUGGUUCCGGGGCGGGCC | 20 | 1131 |
| POLQ-25 | + | CUCCCGAGAGGGAGGACGCU | 20 | 1132 |
| POLQ-26 | − | UCAAACCUCCCGGCCCGCCC | 20 | 1133 |
| POLQ-27 | − | UCGCUGGCGUCUAAGACUUC | 20 | 1134 |
| POLQ-28 | + | UCUAUGGUUCCGGGGCGGGC | 20 | 1135 |
| POLQ-29 | + | UCUCCCGAGAGGGAGGACGC | 20 | 1136 |
| POLQ-30 | + | UUAAGCCACGGAGAACUCUA | 20 | 1137 |

TABLE II.32A

Exemplary HDR-enhancing gRNA Targeting a POLQ Gene

*S. aureus* A high level of orthogonality, starts with a G, PAM is NNGRRT
1st Tier 32A

| gRNA Name | DNA Strand | Targeting Domain | Target Site Length | Seq ID |
|---|---|---|---|---|
| POLQ-31 | + | GUUCCGGGGCGGGCCGGGAGGU | 22 | 1138 |

Table II.32B provides exemplary targeting domains of gRNAs to be used with an eiCas9 fusion molecule (e.g., an eiCas9 fused to a transcription activator or repressor domain) to alter (e.g., activate or repress) a gene, e.g., POLQ gene. The targeting domains of gRNAs were selected according to the second tier parameters. The targeting domains bind within 500 bp spanning a transcription start site (TSS), e.g., upstream or downstream of a TSS, have a high level of orthogonality and PAM is NNGRRT. It is contemplated herein that in an embodiment the targeting domain hybridizes to the target domain through complementary base pairing. Any of the targeting domains in the table can be used with a *S. aureus* eiCas9 fusion molecule (e.g., an eiCas9 fused to a transcription activator or repressor domain) to alter (e.g., activate or repress) the POLQ gene. One or more gRNA may be used to target an eiCas9 fusion molecule to a region spanning 500 bp of a transcription start site (TSS) of the POLQ gene.

TABLE II.32B

Exemplary HDR-enhancing gRNAs Targeting a POLQ Gene

*S. aureus* A high level of orthogonality, and PAM is NNGRRT
2nd Tier 32B

| gRNA Name | DNA Strand | Targeting Domain | Target Site Length | Seq ID |
|---|---|---|---|---|
| POLQ-32 | + | AUGUCCGCAGCUGUUGCCAGGC | 22 | 1139 |
| POLQ-33 | + | CAGCGAGAGCCGCUCCUUCCCC | 22 | 1140 |
| POLQ-34 | − | CUCCCGGCCCGCCCCGGAACCA | 22 | 1141 |
| POLQ-35 | + | CUUCCCCACGAGUCUAUGGCUU | 22 | 1142 |
| POLQ-36 | + | UGGCUUGCCCUGAUCGGCCGAG | 22 | 1143 |

Table II.33A provides exemplary targeting domains of gRNAs to be used with an eiCas9 fusion molecule (e.g., an eiCas9 fused to a transcription activator or repressor domain) to alter (e.g., activate or repress) a gene, e.g., FBXO18 gene. The targeting domains of gRNAs were selected according to the first tier parameters. The targeting domains bind within 500 bp spanning a transcription start site (TSS), e.g., upstream or downstream of a TSS, have a high level of orthogonality and start with a 5'G. It is contemplated herein that in an embodiment the targeting domain hybridizes to the target domain through complementary base pairing. Any of the targeting domains in the table can be used with a *S. pyogenes* eiCas9 fusion molecule (e.g., an eiCas9 fused to a transcription activator or repressor domain) to alter (e.g., activate or repress) the FBXO18 gene. One or more gRNA may be used to target an eiCas9 fusion molecule to a region spanning 500 bp of a transcription start site (TSS) of the FBXO18 gene.

TABLE II.33A

Exemplary HDR-enhancing gRNAs Targeting a FBXO18 Gene

*S. pyogenes* A high level of orthogonality, and starts with a G
1st Tier 33A

| gRNA Name | DNA Strand | Targeting Domain | Target Site Length | Seq ID |
|---|---|---|---|---|
| FBXO18-1 | − | GAAGCGCCCGCCGCCGGAGC | 20 | 1144 |
| FBXO18-2 | − | GACCAAUCGGGACGCGAGAC | 20 | 1145 |

TABLE II.33A-continued

Exemplary HDR-enhancing gRNAs Targeting a FBXO18 Gene

*S. pyogenes* A high level of orthogonality, and starts with a G
1st Tier 33A

| gRNA Name | DNA Strand | Targeting Domain | Target Site Length | Seq ID |
|---|---|---|---|---|
| FBXO18-3 | − | GACCGGAGGGGCGUGCUGA | 20 | 1146 |
| FBXO18-4 | − | GACGGCCCCGCGACCAAUC | 20 | 1147 |
| FBXO18-5 | + | GAGCUCGCGGAGGAAGUCGG | 20 | 1148 |
| FBXO18-6 | + | GAGGAAGUCGGCGGGCGUCU | 20 | 1149 |
| FBXO18-7 | − | GCACUGUGGCGCUCCGGACC | 20 | 1150 |
| FBXO18-8 | + | GCGGAGCUCGCGGAGGAAGU | 20 | 1151 |
| FBXO18-9 | − | GGACCCCCGCGCAGGACCC | 20 | 1152 |
| FBXO18-10 | − | GGAGGGGCGUGCUGACGGA | 20 | 1153 |
| FBXO18-11 | + | GGCCGUCAGUCCGGCUCCGG | 20 | 1154 |
| FBXO18-12 | + | GGGACGCUGGGCUGAGCGGC | 20 | 1155 |
| FBXO18-13 | + | GGGGGCCGUCAGUCCGGCUC | 20 | 1156 |
| FBXO18-14 | + | GGGUCCUGCGCGGGGGUCC | 20 | 1157 |
| FBXO18-15 | + | GGUCGCGGGGCCGUCAGUC | 20 | 1158 |
| FBXO18-16 | + | GUCAGUCCGGCUCCGGCGGC | 20 | 1159 |
| FBXO18-17 | + | GUCCGUCAGCACGCCCCCUC | 20 | 1160 |
| FBXO18-18 | − | GUCUGCGGCCUCACGCACUG | 20 | 1161 |
| FBXO18-19 | + | GUGAGGCCGCAGACGUGGCA | 20 | 1162 |
| FBXO18-20 | + | GUGGGAGGGGCUCCGCCGUG | 20 | 1163 |

Table II.33B provides exemplary targeting domains of gRNAs to be used with an eiCas9 fusion molecule (e.g., an eiCas9 fused to a transcription activator or repressor domain) to alter (e.g., activate or repress) a gene, e.g., FBXO18 gene. The targeting domains of gRNAs were selected according to the second tier parameters. The targeting domains bind within 500 bp spanning a transcription start site (TSS), e.g., upstream or downstream of a TSS and have a high level of orthogonality. It is contemplated herein that in an embodiment the targeting domain hybridizes to the target domain through complementary base pairing. Any of the targeting domains in the table can be used with a *S. pyogenes* eiCas9 fusion molecule (e.g., an eiCas9 fused to a transcription activator or repressor domain) to alter (e.g., activate or repress) the FBXO18 gene. One or more gRNA may be used to target an eiCas9 fusion molecule to a region spanning 500 bp of a transcription start site (TSS) of the FBXO18 gene.

TABLE II.33B

Exemplary HDR-enhancing gRNAs Targeting a FBXO18 Gene

*S. pyogenes* A high level of orthogonality
2nd Tier 33B

| gRNA Name | DNA Strand | Targeting Domain | Target Site Length | Seq ID |
|---|---|---|---|---|
| FBXO18-21 | + | AACCUCCGGGGUCCUGCGCG | 20 | 1164 |
| FBXO18-22 | − | AAUCGGGACGCGAGACCGGA | 20 | 1165 |
| FBXO18-23 | + | ACCUCCGGGGUCCUGCGCGG | 20 | 1166 |

TABLE II.33B-continued

Exemplary HDR-enhancing gRNAs Targeting a FBXO18 Gene

*S. pyogenes* A high level of orthogonality
2nd Tier 33B

| gRNA Name | DNA Strand | Targeting Domain | Target Site Length | Seq ID |
|---|---|---|---|---|
| FBXO18-24 | + | AGAGGAGGAGCUCGCUGCCG | 20 | 1167 |
| FBXO18-25 | + | AGCUCGCGGAGGAAGUCGGC | 20 | 1168 |
| FBXO18-26 | + | AGGAAGUCGGCGGGCGUCUC | 20 | 1169 |
| FBXO18-27 | + | AGUGCGUGAGGCCGCAGACG | 20 | 1170 |
| FBXO18-28 | − | AUCGGGACGCGAGACCGGAG | 20 | 1171 |
| FBXO18-29 | − | CAAUCGGGACGCGAGACCGG | 20 | 1172 |
| FBXO18-30 | − | CGCCGCCGGAGCCGGACUGA | 20 | 1173 |
| FBXO18-31 | + | CGCGUCCCGAUUGGUCGCGG | 20 | 1174 |
| FBXO18-32 | + | CGGCGGGCGUCUCGGGCUCC | 20 | 1175 |
| FBXO18-33 | + | CGUCAGUCCGGCUCCGGCGG | 20 | 1176 |
| FBXO18-34 | + | CUCCGGUCUCGCGUCCCGAU | 20 | 1177 |
| FBXO18-35 | + | CUCGCGUCCCGAUUGGUCGC | 20 | 1178 |
| FBXO18-36 | + | UAACCUCCGGGGUCCUGCGC | 20 | 1179 |
| FBXO18-37 | + | UCGCGUCCCGAUUGGUCGCG | 20 | 1180 |
| FBXO18-38 | + | UCUCGCGUCCCGAUUGGUCG | 20 | 1181 |
| FBXO18-39 | − | UGACGGCCCCCGCGACCAAU | 20 | 1182 |
| FBXO18-40 | + | UUAACCUCCGGGGUCCUGCG | 20 | 1183 |

Table II.34A provides exemplary targeting domains of gRNAs to be used with an eiCas9 fusion molecule (e.g., an eiCas9 fused to a transcription activator or repressor domain) to alter (e.g., activate or repress) a gene, e.g., FBXO18 gene. The targeting domains of gRNAs were selected according to the first tier parameters. The targeting domains bind within 500 bp spanning a transcription start site (TSS), e.g., upstream or downstream of a TSS, have a high level of orthogonality, start with a 5'G and PAM is NNGRRT. It is contemplated herein that in an embodiment the targeting domain hybridizes to the target domain through complementary base pairing. Any of the targeting domains in the table can be used with a *S. aureus* eiCas9 fusion molecule (e.g., an eiCas9 fused to a transcription activator or repressor domain) to alter (e.g., activate or repress) the FBXO18 gene. One or more gRNA may be used to target an eiCas9 fusion molecule to a region spanning 500 bp of a transcription start site (TSS) of the FBXO18 gene.

TABLE II.34A

Exemplary HDR-enhancing gRNAs Targeting a FBXO18 Gene

*S. aureus* A high level of orthogonality, starts with a G,
PAM is NNGRRT
1st Tier 34A

| gRNA Name | DNA Strand | Targeting Domain | Target Site Length | Seq ID |
|---|---|---|---|---|
| FBXO18-41 | + | GCCGUGUGGAAAACUUAACCUC | 22 | 1184 |
| FBXO18-42 | + | GCGGGCCCGGCGGCGGCGGCAG | 22 | 1185 |
| FBXO18-43 | + | GCGUGAGGCCGCAGACGUGGCA | 22 | 1186 |

Table II.34B provides exemplary targeting domains of gRNAs to be used with an eiCas9 fusion molecule (e.g., an eiCas9 fused to a transcription activator or repressor domain) to alter (e.g., activate or repress) a gene, e.g., FBXO18 gene. The targeting domains of gRNAs were selected according to the second tier parameters. The targeting domains bind within 500 bp spanning a transcription start site (TSS), e.g., upstream or downstream of a TSS, have a high level of orthogonality and PAM is NNGRRT. It is contemplated herein that in an embodiment the targeting domain hybridizes to the target domain through complementary base pairing. Any of the targeting domains in the table can be used with a S. aureus eiCas9 fusion molecule (e.g., an eiCas9 fused to a transcription activator or repressor domain) to alter (e.g., activate or repress) the FBXO18 gene. One or more gRNA may be used to target an eiCas9 fusion molecule to a region spanning 500 bp of a transcription start site (TSS) of the FBXO18 gene.

TABLE II.34B

Exemplary HDR-enhancing gRNAs Targeting a FBXO18 Gene

S. aureus A high level of orthogonality, and PAM is NNGRRT
2nd Tier 34B

| gRNA Name | DNA Strand | Targeting Domain | Target Site Length | Seq ID |
| --- | --- | --- | --- | --- |
| FBXO18-44 | + | CCGGCGGCGGCGGCAGCGGGGU | 22 | 1187 |
| FBXO18-45 | + | UCCUGCGCGGGGGUCCGGGCC | 22 | 1188 |
| FBXO18-46 | + | UUAACCUCCGGGGUCCUGCGCG | 22 | 1189 |

Table II.35A provides exemplary targeting domains of gRNAs to be used with an eiCas9 fusion molecule (e.g., an eiCas9 fused to a transcription activator or repressor domain) to alter (e.g., activate or repress) a gene, e.g., RTEL1 gene. The targeting domains of gRNAs were selected according to the first tier parameters. The targeting domains bind within 500 bp spanning a transcription start site (TSS), e.g., upstream or downstream of a TSS, have a high level of orthogonality and start with a 5'G. It is contemplated herein that in an embodiment the targeting domain hybridizes to the target domain through complementary base pairing. Any of the targeting domains in the table can be used with a S. pyogenes eiCas9 fusion molecule (e.g., an eiCas9 fused to a transcription activator or repressor domain) to alter (e.g., activate or repress) the RTEL1 gene. One or more gRNA may be used to target an eiCas9 fusion molecule to a region spanning 500 bp of a transcription start site (TSS) of the RTEL1 gene.

TABLE II.35A

Exemplary HDR-enhancing gRNAs Targeting a RTEL1 Gene

S. pyogenes A high level of orthogonality, and starts with a G
1st Tier 35A

| gRNA Name | DNA Strand | Targeting Domain | Target Site Length | Seq ID |
| --- | --- | --- | --- | --- |
| RTEL1-1 | − | GAAACUGUUCCCCCGCGGAG | 20 | 1190 |
| RTEL1-2 | + | GAACGCGCAAAACGCCGUGU | 20 | 1191 |
| RTEL1-3 | + | GACGGGUGGCGGCCCUCGAC | 20 | 1192 |
| RTEL1-4 | + | GAGCAGGCGGACCCCCUCCG | 20 | 1193 |
| RTEL1-5 | − | GAGGGGGUCCGCCUGCUCUU | 20 | 1194 |

TABLE II.35A-continued

Exemplary HDR-enhancing gRNAs Targeting a RTEL1 Gene

*S. pyogenes* A high level of orthogonality, and starts with a G
1st Tier 35A

| gRNA Name | DNA Strand | Targeting Domain | Target Site Length | Seq ID |
|---|---|---|---|---|
| RTEL1-6 | − | GCACUUCCGCCCCCCACUUC | 20 | 1195 |
| RTEL1-7 | + | GCAGGCGGACCCCCUCCGCG | 20 | 1196 |
| RTEL1-8 | − | GCCUGCUCUUCGGCUCCUCC | 20 | 1197 |
| RTEL1-9 | + | GCCUGGAGGAGCCGAAGAGC | 20 | 1198 |
| RTEL1-10 | − | GCGGCGAACCUUCCAGAACC | 20 | 1199 |
| RTEL1-11 | + | GCGGGGGAACAGUUUCCGCC | 20 | 1200 |
| RTEL1-12 | + | GCUGGCUGACAGCUGGGGAC | 20 | 1201 |
| RTEL1-13 | − | GGAAACUGUUCCCCCGCGGA | 20 | 1202 |
| RTEL1-14 | + | GGAGUCGGUUGAGUUCCUGA | 20 | 1203 |
| RTEL1-15 | + | GGCUGACAGCUGGGGACGGG | 20 | 1204 |
| RTEL1-16 | + | GGGAGCACAAAGCAACGGAC | 20 | 1205 |
| RTEL1-17 | − | GGUCCGUUGCUUUGUGCUCC | 20 | 1206 |
| RTEL1-18 | + | GUGGGGGGCGGAAGUGCAGU | 20 | 1207 |
| RTEL1-19 | + | GUUGAGUUCCUGAGGGACCC | 20 | 1208 |

Table II.35B provides exemplary targeting domains of gRNAs to be used with an eiCas9 fusion molecule (e.g., an eiCas9 fused to a transcription activator or repressor domain) to alter (e.g., activate or repress) a gene, e.g., RTEL1 gene. The targeting domains of gRNAs were selected according to the second tier parameters. The targeting domains bind within 500 bp spanning a transcription start site (TSS), e.g., upstream or downstream of a TSS and have a high level of orthogonality. It is contemplated herein that in an embodiment the targeting domain hybridizes to the target domain through complementary base pairing. Any of the targeting domains in the table can be used with a *S. pyogenes* eiCas9 fusion molecule (e.g., an eiCas9 fused to a transcription activator or repressor domain) to alter (e.g., activate or repress) the RTEL1 gene. One or more gRNA may be used to target an eiCas9 fusion molecule to a region spanning 500 bp of a transcription start site (TSS) of the RTEL1 gene.

TABLE II.35B

Exemplary HDR-enhancing gRNAs Targeting a RTEL1 Gene

*S. pyogenes* A high level of orthogonality
2nd Tier 35B

| gRNA Name | DNA Strand | Targeting Domain | Target Site Length | Seq ID |
|---|---|---|---|---|
| RTEL1-20 | + | AAAACGCCGUGUAGGCCUGG | 20 | 1209 |
| RTEL1-21 | − | AAACUGUUCCCCCGCGGAGG | 20 | 1210 |
| RTEL1-22 | + | AAAGCAACGGACCGGAAGUG | 20 | 1211 |
| RTEL1-23 | + | AACGGACCGGAAGUGGGGGG | 20 | 1212 |
| RTEL1-24 | − | AACUCAACCGACUCCAGUCG | 20 | 1213 |

TABLE II.35B-continued

Exemplary HDR-enhancing gRNAs Targeting a RTEL1 Gene

S. pyogenes A high level of orthogonality
2nd Tier 35B

| gRNA Name | DNA Strand | Targeting Domain | Target Site Length | Seq ID |
|---|---|---|---|---|
| RTEL1-25 | + | ACAAAGCAACGGACCGGAAG | 20 | 1214 |
| RTEL1-26 | − | ACUCAACCGACUCCAGUCGA | 20 | 1215 |
| RTEL1-27 | + | ACUCUGAGCUGGCUGACAGC | 20 | 1216 |
| RTEL1-28 | + | AGCAACGGACCGGAAGUGGG | 20 | 1217 |
| RTEL1-29 | − | AGCCAGCUCAGAGUUUUCGC | 20 | 1218 |
| RTEL1-30 | + | CAAAGCAACGGACCGGAAGU | 20 | 1219 |
| RTEL1-31 | + | CGCAAAACGCCGUGUAGGCC | 20 | 1220 |
| RTEL1-32 | − | CGCGGCGAACCUUCCAGAAC | 20 | 1221 |
| RTEL1-33 | + | CGCGGGGGAACAGUUUCCGC | 20 | 1222 |
| RTEL1-34 | − | CGGAAACUGUUCCCCCGCGG | 20 | 1223 |
| RTEL1-35 | − | CGGCGGAAACUGUUCCCCCG | 20 | 1224 |
| RTEL1-36 | + | CGGUUCUGGAAGGUUCGCCG | 20 | 1225 |
| RTEL1-37 | − | CGUUUUGCGCGUUCUGUGUC | 20 | 1226 |
| RTEL1-38 | + | UGCCCGCGAAAACUCUGAGC | 20 | 1227 |
| RTEL1-39 | + | UUCCUGAGGGACCCCGGUUC | 20 | 1228 |

Table II.36A provides exemplary targeting domains of gRNAs to be used with an eiCas9 fusion molecule (e.g., an eiCas9 fused to a transcription activator or repressor domain) to alter (e.g., activate or repress) a gene, e.g., RTEL1 gene. The targeting domains of gRNAs were selected according to the first tier parameters. The targeting domains bind within 500 bp spanning a transcription start site (TSS), e.g., upstream or downstream of a TSS, have a high level of orthogonality, start with a 5'G and PAM is NNGRRT. It is contemplated herein that in an embodiment the targeting domain hybridizes to the target domain through complementary base pairing. Any of the targeting domains in the table can be used with a S. aureus eiCas9 fusion molecule (e.g., an eiCas9 fused to a transcription activator or repressor domain) to alter (e.g., activate or repress) the RTEL1 gene. One or more gRNA may be used to target an eiCas9 fusion molecule to a region spanning 500 bp of a transcription start site (TSS) of the RTEL1 gene.

TABLE II.36A

Exemplary HDR-enhancing gRNAs Targeting a RTEL1 Gene

S. aureus A high level of orthogonality, starts with a G, PAM is NNGRRT
36A

| 1st Tier gRNA Name | DNA Strand | Targeting Domain | Target Site Length | Seq ID |
|---|---|---|---|---|
| RTEL1-40 | − | GCGGAAACUGUUCCCCCGCGGA | 22 | 1229 |
| RTEL1-41 | + | GGCGGCCCUCGACUGGAGUCGG | 22 | 1230 |
| RTEL1-42 | + | GGGACGGGUGGCGGCCCUCGAC | 22 | 1231 |

Table II.36B provides exemplary targeting domains of gRNAs to be used with an eiCas9 fusion molecule (e.g., an eiCas9 fused to a transcription activator or repressor domain) to alter (e.g., activate or repress) a gene, e.g., RTEL1 gene. The targeting domains of gRNAs were selected according to the second tier parameters. The targeting domains bind within 500 bp spanning a transcription start site (TSS), e.g., upstream or downstream of a TSS, have a high level of orthogonality and PAM is NNGRRT. It is contemplated herein that in an embodiment the targeting domain hybridizes to the target domain through complementary base pairing. Any of the targeting domains in the table can be used with a S. aureus eiCas9 fusion molecule (e.g., an eiCas9 fused to a transcription activator or repressor domain) to alter (e.g., activate or repress) the RTEL1 gene. One or more gRNA may be used to target an eiCas9 fusion molecule to a region spanning 500 bp of a transcription start site (TSS) of the RTEL1 gene.

TABLE II.36B

Exemplary HDR-enhancing gRNAs Targeting a RTEL1 Gene

| S. aureus | A high level of orthogonality, and PAM is NNGRRT 36B | | | |
|---|---|---|---|---|
| 2nd Tier gRNA Name | DNA Strand | Targeting Domain | Target Site Length | Seq ID |
| RTEL1-43 | − | CGUCCCCAGCUGUCAGCCAGCU | 22 | 1232 |
| RTEL1-44 | + | CUGAGCUGGCUGACAGCUGGGG | 22 | 1233 |
| RTEL1-45 | − | UCCGCGGCGAACCUUCCAGAAC | 22 | 1234 |

Table II.37A provides exemplary targeting domains of gRNAs to be used with an eiCas9 fusion molecule (e.g., an eiCas9 fused to a transcription activator or repressor domain) to alter (e.g., activate or repress) a gene, e.g., PARPBP gene. The targeting domains of gRNAs were selected according to the first tier parameters. The targeting domains bind within 500 bp spanning a transcription start site (TSS), e.g., upstream or downstream of a TSS, have a high level of orthogonality and start with a 5'G. It is contemplated herein that in an embodiment the targeting domain hybridizes to the target domain through complementary base pairing. Any of the targeting domains in the table can be used with a S. pyogenes eiCas9 fusion molecule (e.g., an eiCas9 fused to a transcription activator or repressor domain) to alter (e.g., activate or repress) the PARPBP gene. One or more gRNA may be used to target an eiCas9 fusion molecule to a region spanning 500 bp of a transcription start site (TSS) of the PARPBP gene.

TABLE II.37A

Exemplary HDR-enhancing gRNAs Targeting a PARPBP Gene

| S. pyogenes | A high level of orthogonality, and starts with a G 37A | | | |
|---|---|---|---|---|
| 1st Tier gRNA Name | DNA Strand | Targeting Domain | Target Site Length | Seq ID |
| PARPBP-1 | − | GAAUACAGUUCAAACCUCGC | 20 | 1235 |
| PARPBP-2 | − | GACGCGAGACUUACGUGAUU | 20 | 1236 |
| PARPBP-3 | + | GAGCGCAGCGAUUGGCUCCC | 20 | 1237 |
| PARPBP-4 | + | GAGGCAGGCUGGUCUUCCUU | 20 | 1238 |

TABLE II.37A-continued

Exemplary HDR-enhancing gRNAs Targeting a PARPBP Gene

S. pyogenes — A high level of orthogonality, and starts with a G
37A

| 1st Tier gRNA Name | DNA Strand | Targeting Domain | Target Site Length | Seq ID |
|---|---|---|---|---|
| PARPBP-5 | + | GAGGUUUGAACUGUAUUCAG | 20 | 1239 |
| PARPBP-6 | + | GCAUUUUUAAGUGGUGAUUC | 20 | 1240 |
| PARPBP-7 | + | GCCGCGGGAGGGCAUCCCGU | 20 | 1241 |
| PARPBP-8 | + | GCGACUGCGGCGGCCGCGGG | 20 | 1242 |
| PARPBP-9 | − | GCGCGUCGCGGCAGCCCCCA | 20 | 1243 |
| PARPBP-10 | + | GCGGCGACUGCGGCGGCCGC | 20 | 1244 |
| PARPBP-11 | − | GCUGCGCUCGCCCUCCGACC | 20 | 1245 |
| PARPBP-12 | + | GGCAGGCUGGUCUUCCUUGG | 20 | 1246 |
| PARPBP-13 | + | GGCGACAGCGGCGACUGCGG | 20 | 1247 |
| PARPBP-14 | + | GGCUCCCGGGGCCUCCCGCG | 20 | 1248 |
| PARPBP-15 | + | GGCUCUGCUUCCGGGUCGGA | 20 | 1249 |
| PARPBP-16 | + | GGGGCUGCCGCGACGCGCUG | 20 | 1250 |
| PARPBP-17 | − | GUGUGCGGAAGGAUCCCCAA | 20 | 1251 |

Table II.37B provides exemplary targeting domains of gRNAs to be used with an eiCas9 fusion molecule (e.g., an eiCas9 fused to a transcription activator or repressor domain) to alter (e.g., activate or repress) a gene, e.g., PARPBP gene. The targeting domains of gRNAs were selected according to the second tier parameters. The targeting domains bind within 500 bp spanning a transcription start site (TSS), e.g., upstream or downstream of a TSS and have a high level of orthogonality. It is contemplated herein that in an embodiment the targeting domain hybridizes to the target domain through complementary base pairing. Any of the targeting domains in the table can be used with a S. pyogenes eiCas9 fusion molecule (e.g., an eiCas9 fused to a transcription activator or repressor domain) to alter (e.g., activate or repress) the PARPBP gene. One or more gRNA may be used to target an eiCas9 fusion molecule to a region spanning 500 bp of a transcription start site (TSS) of the PARPBP gene.

TABLE II.37B

Exemplary HDR-enhancing gRNAs Targeting a PARPBP Gene

S. pyogenes — A high level of orthogonality
37B

| 2nd Tier gRNA Name | DNA Strand | Targeting Domain | Target Site Length | Seq ID |
|---|---|---|---|---|
| PARPBP-18 | − | AAGACGUACUCUUCAGUGUG | 20 | 1252 |
| PARPBP-19 | − | ACGCGAGACUUACGUGAUUA | 20 | 1253 |
| PARPBP-20 | + | ACGCGCUGUGGCUCUGCUUC | 20 | 1254 |
| PARPBP-21 | + | ACUGUAUUCAGCGGCGACAG | 20 | 1255 |
| PARPBP-22 | − | AGCAGAGCCACAGCGCGUCG | 20 | 1256 |
| PARPBP-23 | + | AGCGCAGCGAUUGGCUCCCG | 20 | 1257 |

TABLE II.37B-continued

Exemplary HDR-enhancing gRNAs Targeting a PARPBP Gene

S. pyogenes — A high level of orthogonality 37B

| 2nd Tier gRNA Name | DNA Strand | Targeting Domain | Target Site Length | Seq ID |
|---|---|---|---|---|
| PARPBP-24 | + | CACACUGAAGAGUACGUCUU | 20 | 1258 |
| PARPBP-25 | − | CCCAACGGGAUGCCCUCCCG | 20 | 1259 |
| PARPBP-26 | + | CCGCGGGAGGGCAUCCCGUU | 20 | 1260 |
| PARPBP-27 | + | CGAGCGCAGCGAUUGGCUCC | 20 | 1261 |
| PARPBP-28 | − | CGCGAGACUUACGUGAUUAG | 20 | 1262 |
| PARPBP-29 | + | CGCGGGAGGGCAUCCCGUUG | 20 | 1263 |
| PARPBP-30 | + | CGGAGGGCGAGCGCAGCGAU | 20 | 1264 |
| PARPBP-31 | − | CGUACUCUUCAGUGUGCGGA | 20 | 1265 |
| PARPBP-32 | − | UACAGUUCAAACCUCGCGGG | 20 | 1266 |
| PARPBP-33 | − | UCAAACCUCGCGGGAGGCCC | 20 | 1267 |
| PARPBP-34 | − | UCACCACUUAAAAAUGCGAC | 20 | 1268 |
| PARPBP-35 | − | UGAAUACAGUUCAAACCUCG | 20 | 1269 |
| PARPBP-36 | + | UGCCCUGUCGCAUUUUUAAG | 20 | 1270 |
| PARPBP-37 | − | UGUGCGGAAGGAUCCCCAAC | 20 | 1271 |

Table II.38A provides exemplary targeting domains of gRNAs to be used with an eiCas9 fusion molecule (e.g., an eiCas9 fused to a transcription activator or repressor domain) to alter (e.g., activate or repress) a gene, e.g., PARPBP gene. The targeting domains of gRNAs were selected according to the first tier parameters. The targeting domains bind within 500 bp spanning a transcription start site (TSS), e.g., upstream or downstream of a TSS, have a high level of orthogonality, start with a 5'G and PAM is NNGRRT. It is contemplated herein that in an embodiment the targeting domain hybridizes to the target domain through complementary base pairing. Any of the targeting domains in the table can be used with a S. aureus eiCas9 fusion molecule (e.g., an eiCas9 fused to a transcription activator or repressor domain) to alter (e.g., activate or repress) the PARPBP gene. One or more gRNA may be used to target an eiCas9 fusion molecule to a region spanning 500 bp of a transcription start site (TSS) of the PARPBP gene.

TABLE II.38A

Exemplary HDR-enhancing gRNAs Targeting a PARPBP Gene

S. aureus — A high level of orthogonality, starts with a G, PAM is NNGRRT 38A

| 1st Tier gRNA Name | DNA Strand | Targeting Domain | Target Site Length | Seq ID |
|---|---|---|---|---|
| PARPBP-38 | − | GCCGCAGUCGCCGCUGUCGCCG | 22 | 1272 |
| PARPBP-39 | + | GCGACGCGCUGUGGCUCUGCUU | 22 | 1273 |
| PARPBP-40 | + | GGCCGCGGGAGGGCAUCCCGUU | 22 | 1274 |

Table II.38B provides exemplary targeting domains of gRNAs to be used with an eiCas9 fusion molecule (e.g., an eiCas9 fused to a transcription activator or repressor domain) to alter (e.g., activate or repress) a gene, e.g., PARPBP gene. The targeting domains of gRNAs were selected according to the second tier parameters. The targeting domains bind within 500 bp spanning a transcription start site (TSS), e.g., upstream or downstream of a TSS, have a high level of orthogonality and PAM is NNGRRT. It is contemplated herein that in an embodiment the targeting domain hybridizes to the target domain through complementary base pairing. Any of the targeting domains in the table can be used with a *S. aureus* eiCas9 fusion molecule (e.g., an eiCas9 fused to a transcription activator or repressor domain) to alter (e.g., activate or repress) the PARPBP gene. One or more gRNA may be used to target an eiCas9 fusion molecule to a region spanning 500 bp of a transcription start site (TSS) of the PARPBP gene.

TABLE II.38B

Exemplary HDR-enhancing gRNAs Targeting a PARPBP Gene

*S. aureus*: A high level of orthogonality, and PAM is NNGRRT 38B

| 2nd Tier gRNA Name | DNA Strand | Targeting Domain | Target Site Length | Seq ID |
|---|---|---|---|---|
| PARPBP-41 | − | AGACGUACUCUUCAGUGUGCGG | 22 | 1275 |
| PARPBP-42 | − | CAGACGCGAGACUUACGUGAUU | 22 | 1276 |
| PARPBP-43 | − | CAGUGUGCGGAAGGAUCCCCAA | 22 | 1277 |
| PARPBP-44 | + | CCGCACACUGAAGAGUACGUCU | 22 | 1278 |
| PARPBP-45 | + | UUGGGGAUCCUUCCGCACACUG | 22 | 1279 |

Table II.39A provides exemplary targeting domains of gRNAs to be used with an eiCas9 fusion molecule (e.g., an eiCas9 fused to a transcription activator or repressor domain) to alter (e.g., activate or repress) a gene, e.g., UIMC1 gene. The targeting domains of gRNAs were selected according to the first tier parameters. The targeting domains bind within 500 bp spanning a transcription start site (TSS), e.g., upstream or downstream of a TSS, have a high level of orthogonality and start with a 5'G. It is contemplated herein that in an embodiment the targeting domain hybridizes to the target domain through complementary base pairing. Any of the targeting domains in the table can be used with a *S. pyogenes* eiCas9 fusion molecule (e.g., an eiCas9 fused to a transcription activator or repressor domain) to alter (e.g., activate or repress) the UIMC1 gene. One or more gRNA may be used to target an eiCas9 fusion molecule to a region spanning 500 bp of a transcription start site (TSS) of the UIMC1 gene.

TABLE II.39A

Exemplary HDR-enhancing gRNAs Targeting a UIMC1 Gene

*S. pyogenes*: A high level of orthogonality, and starts with a G 39A

| 1st Tier gRNA Name | DNA Strand | Targeting Domain | Target Site Length | Seq ID |
|---|---|---|---|---|
| UIMC1-1 | − | GAAUCCGCCCCGGAAUCGGG | 20 | 1280 |
| UIMC1-2 | + | GACCGGCCAUUACUGGUGCC | 20 | 1281 |
| UIMC1-3 | − | GACUUAACCAACCCCGCCG | 20 | 1282 |
| UIMC1-4 | − | GCACCAGUAAUGGCCGGUCC | 20 | 1283 |
| UIMC1-5 | − | GCCACACGUUGGGAGCGCGG | 20 | 1284 |

TABLE II.39A-continued

Exemplary HDR-enhancing gRNAs Targeting a UIMC1 Gene

S. pyogenes — A high level of orthogonality, and starts with a G — 39A

| 1st Tier gRNA Name | DNA Strand | Targeting Domain | Target Site Length | Seq ID |
|---|---|---|---|---|
| UIMC1-6 | − | GCCGCCACACGUUGGGAGCG | 20 | 1285 |
| UIMC1-7 | − | GCGUCGCGAGAGACACACCC | 20 | 1286 |
| UIMC1-8 | − | GGACGUACCAACUGCGCGGG | 20 | 1287 |
| UIMC1-9 | − | GGCGGCGGGUACUCACUCGC | 20 | 1288 |
| UIMC1-10 | + | GGGGUGUGUCUCUCGCGACG | 20 | 1289 |
| UIMC1-11 | + | GGGUGUGUCUCUCGCGACGC | 20 | 1290 |
| UIMC1-12 | − | GGUCGCGAGCCGCCACACGU | 20 | 1291 |
| UIMC1-13 | + | GGUGUGUCUCUCGCGACGCG | 20 | 1292 |
| UIMC1-14 | − | GUAGACCUUCUCCGGGUUGC | 20 | 1293 |
| UIMC1-15 | + | GUCCCUCCGGACGCCGAAGU | 20 | 1294 |
| UIMC1-16 | + | GUCCGCGGCCCGCUACUCUC | 20 | 1295 |
| UIMC1-17 | − | GUCGCGAGCCGCCACACGUU | 20 | 1296 |
| UIMC1-18 | + | GUCUCUCGCGACGCGGGGGU | 20 | 1297 |
| UIMC1-19 | + | GUGUGGCGGCUCGCGACCCC | 20 | 1298 |
| UIMC1-20 | + | GUGUGUCUCUCGCGACGCGG | 20 | 1299 |

Table II.39B provides exemplary targeting domains of gRNAs to be used with an eiCas9 fusion molecule (e.g., an eiCas9 fused to a transcription activator or repressor domain) to alter (e.g., activate or repress) a gene, e.g., UIMC1 gene. The targeting domains of gRNAs were selected according to the second tier parameters. The targeting domains bind within 500 bp spanning a transcription start site (TSS), e.g., upstream or downstream of a TSS and have a high level of orthogonality. It is contemplated herein that in an embodiment the targeting domain hybridizes to the target domain through complementary base pairing. Any of the targeting domains in the table can be used with a S. pyogenes eiCas9 fusion molecule (e.g., an eiCas9 fused to a transcription activator or repressor domain) to alter (e.g., activate or repress) the UIMC1 gene. One or more gRNA may be used to target an eiCas9 fusion molecule to a region spanning 500 bp of a transcription start site (TSS) of the UIMC1 gene.

TABLE II.39B

Exemplary HDR-enhancing gRNAs Targeting a UIMC1 Gene

S. pyogenes — A high level of orthogonality — 398

| 2nd Tier gRNA Name | DNA Strand | Targeting Domain | Target Site Length | Seq ID |
|---|---|---|---|---|
| UIMC1-21 | − | AACCCGGCACCAGUAAUGGC | 20 | 1300 |
| UIMC1-22 | − | AAUCCGCCCCGGAAUCGGGA | 20 | 1301 |
| UIMC1-23 | + | ACGCCGGGACCGGCCAUUAC | 20 | 1302 |
| UIMC1-24 | − | ACUUAACCAACCCCCGCCGC | 20 | 1303 |
| UIMC1-25 | − | AGCCCACUUCGGCGUCCGGA | 20 | 1304 |
| UIMC1-26 | + | AGGUAGGCCUCUCCCGACGC | 20 | 1305 |
| UIMC1-27 | + | CCCGAUUCCGGGGCGGAUUC | 20 | 1306 |
| UIMC1-28 | + | CCCGCGCAGUUGGUACGUCC | 20 | 1307 |
| UIMC1-29 | + | CCGCCCCGAGAGCGUGUCUC | 20 | 1308 |

TABLE II.39B-continued

Exemplary HDR-enhancing gRNAs Targeting a UIMC1 Gene

| S. pyogenes | | A high level of orthogonality 398 | | |
|---|---|---|---|---|
| 2nd Tier gRNA Name | DNA Strand | Targeting Domain | Target Site Length | Seq ID |
| UIMC1-30 | − | CCGGAAUCCGCCCCGGAAUC | 20 | 1309 |
| UIMC1-31 | − | CCGGGACGUACCAACUGCGC | 20 | 1310 |
| UIMC1-32 | + | CGCAGUUGGUACGUCCCGGA | 20 | 1311 |
| UIMC1-33 | + | CGGCCCGCUACUCUCCGGGA | 20 | 1312 |
| UIMC1-34 | + | CGUCCCGGAUGGCUCCCCCG | 20 | 1313 |
| UIMC1-35 | − | UAAUGGCCGGUCCCGGCGUC | 20 | 1314 |
| UIMC1-36 | − | UCCGGAAUCCGCCCCGGAAU | 20 | 1315 |
| UIMC1-37 | + | UCCGGACGCCGAAGUGGGCU | 20 | 1316 |
| UIMC1-38 | − | UCCGGGACGUACCAACUGCG | 20 | 1317 |
| UIMC1-39 | + | UGUCUCUCGCGACGCGGGGG | 20 | 1318 |
| UIMC1-40 | − | UUAACCAACCCCCGCCGCGG | 20 | 1319 |

Table II.40A provides exemplary targeting domains of gRNAs to be used with an eiCas9 fusion molecule (e.g., an eiCas9 fused to a transcription activator or repressor domain) to alter (e.g., activate or repress) a gene, e.g., UIMC1 gene. The targeting domains of gRNAs were selected according to the first tier parameters. The targeting domains bind within 500 bp spanning a transcription start site (TSS), e.g., upstream or downstream of a TSS, have a high level of orthogonality, start with a 5'G and PAM is NNGRRT. It is contemplated herein that in an embodiment the targeting domain hybridizes to the target domain through complementary base pairing. Any of the targeting domains in the table can be used with a S. aureus eiCas9 fusion molecule (e.g., an eiCas9 fused to a transcription activator or repressor domain) to alter (e.g., activate or repress) the UIMC1 gene. One or more gRNA may be used to target an eiCas9 fusion molecule to a region spanning 500 bp of a transcription start site (TSS) of the UIMC1 gene.

Table II.40B provides exemplary targeting domains of gRNAs to be used with an eiCas9 fusion molecule (e.g., an eiCas9 fused to a transcription activator or repressor domain) to alter (e.g., activate or repress) a gene, e.g., UIMC1 gene. The targeting domains of gRNAs were selected according to the second tier parameters. The targeting domains bind within 500 bp spanning a transcription start site (TSS), e.g., upstream or downstream of a TSS, have a high level of orthogonality and PAM is NNGRRT. It is contemplated herein that in an embodiment the targeting domain hybridizes to the target domain through complementary base pairing. Any of the targeting domains in the table can be used with a S. aureus eiCas9 fusion molecule (e.g., an eiCas9 fused to a transcription activator or repressor domain) to alter (e.g., activate or repress) the UIMC1 gene. One or more gRNA may be used to target an eiCas9 fusion molecule to a region spanning 500 bp of a transcription start site (TSS) of the UIMC1 gene.

TABLE II.40A

Exemplary HDR-enhancing gRNAs Targeting a UIMC1 Gene

| S. aureus | | A high level of orthogonality, starts with a G, PAM is NNGRRT 40A | | |
|---|---|---|---|---|
| 1st Tier gRNA Name | DNA Strand | Targeting Domain | Target Site Length | Seq ID |
| UIMC1-41 | − | GCGUCGGGAAGCGCCCCUCCCG | 22 | 1320 |
| UIMC1-42 | + | GCUGGCCUUGCCGAAGUCGGGG | 22 | 1321 |
| UIMC1-43 | + | GUCUACAGAGCGGCCUGCGCCA | 22 | 1322 |

TABLE II.40B

Exemplary HDR-enhancing gRNAs Targeting a UIMC1 Gene

S. aureus — A high level of orthogonality, and PAM is NNGRRT — 40B

| 2nd Tier gRNA Name | DNA Strand | Targeting Domain | Target Site Length | Seq ID |
|---|---|---|---|---|
| UIMC1-44 | + | ACAGAGCGGCCUGCGCCAGCGA | 22 | 1323 |
| UIMC1-45 | − | AGUAAUGGCCGGUCCCGGCGUC | 22 | 1324 |
| UIMC1-46 | − | CAGGCCGCUCUGUAGACCUUCU | 22 | 1325 |
| UIMC1-47 | + | CCCUGCCUCCUUUUCUUCCUCA | 22 | 1326 |
| UIMC1-48 | − | CCGGAAUCCGCCCCGGAAUCGG | 22 | 1327 |
| UIMC1-49 | + | CCGGGACCGGCCAUUACUGGUG | 22 | 1328 |
| UIMC1-50 | + | CCGGGGCGGCCCUUCCUGAUGC | 22 | 1329 |
| UIMC1-51 | + | CCUCCCGCGCAGUUGGUACGUC | 22 | 1330 |
| UIMC1-52 | + | CCUCCGGACGCCGAAGUGGGCU | 22 | 1331 |
| UIMC1-53 | + | CGGGGCUGGCCUUGCCGAAGUC | 22 | 1332 |
| UIMC1-54 | + | CGGGGUGUGUCUCUCGCGACGC | 22 | 1333 |
| UIMC1-55 | + | CUGGGACCCUCCCGAUUCCGGG | 22 | 1334 |
| UIMC1-56 | + | UCCCGGAUGGCUCCCCCGCGGC | 22 | 1335 |
| UIMC1-57 | − | UCCCGGCGUCCGGAAUCCGCCC | 22 | 1336 |
| UIMC1-58 | − | UGAGGAAGAAAAGGAGGCAGGG | 22 | 1337 |
| UIMC1-59 | − | UGGGCGGAGCUGUGCGCAGGCG | 22 | 1338 |
| UIMC1-60 | − | UGUAGACCUUCUCCGGGUUGCC | 22 | 1339 |

Table II.41A provides exemplary targeting domains of gRNAs to be used with an eiCas9 fusion molecule (e.g., an eiCas9 fused to a transcription activator or repressor domain) to alter (e.g., activate or repress) a gene, e.g., RAD52 gene. The targeting domains of gRNAs were selected according to the first tier parameters. The targeting domains bind within 500 bp spanning a transcription start site (TSS), e.g., upstream or downstream of a TSS, have a high level of orthogonality and start with a 5'G. It is contemplated herein that in an embodiment the targeting domain hybridizes to the target domain through complementary base pairing. Any of the targeting domains in the table can be used with a *S. pyogenes* eiCas9 fusion molecule (e.g., an eiCas9 fused to a transcription activator or repressor domain) to alter (e.g., activate or repress) the RAD52 gene. One or more gRNA may be used to target an eiCas9 fusion molecule to a region spanning 500 bp of a transcription start site (TSS) of the RAD52 gene.

TABLE II.41A

Exemplary HDR-enhancing gRNAs Targeting a RAD52 Gene

S. pyogenes — A high level of orthogonality, and starts with a G — 41A

| 1st Tier gRNA Name | DNA Strand | Targeting Domain | Target Site Length | Seq ID |
|---|---|---|---|---|
| RAD52-1 | − | GAACCCACGCCCAGCGCCGG | 20 | 1340 |
| RAD52-2 | − | GAACCGUAAAUCAAGUCGGA | 20 | 1341 |
| RAD52-3 | − | GAAGGAACCGUAAAUCAAGU | 20 | 1342 |
| RAD52-4 | − | GAAGGGUGCGCGAGCGUCUC | 20 | 1343 |
| RAD52-5 | + | GAGAGCGGCUUCCCCCGGGG | 20 | 1344 |
| RAD52-6 | + | GAGGAGAGCGGCUUCCCCCG | 20 | 1345 |
| RAD52-7 | − | GAGGCCGCGCAGAGGAGAAU | 20 | 1346 |

TABLE II.41A-continued

Exemplary HDR-enhancing gRNAs Targeting a RAD52 Gene

S. pyogenes — A high level of orthogonality, and starts with a G
41A

| 1st Tier gRNA Name | DNA Strand | Targeting Domain | Target Site Length | Seq ID |
|---|---|---|---|---|
| RAD52-8 | - | GCACACAGGGAGCUCGAUCU | 20 | 1347 |
| RAD52-9 | - | GCAGCCCCAGGUUCUCGACC | 20 | 1348 |
| RAD52-10 | + | GCUGCCCGAGGCGCGUAAGU | 20 | 1349 |
| RAD52-11 | + | GCUUCCGGGUCGAGAACCUG | 20 | 1350 |
| RAD52-12 | - | GGAACCGUAAAUCAAGUCGG | 20 | 1351 |
| RAD52-13 | + | GGAGGAGAGCGGCUUCCCCC | 20 | 1352 |
| RAD52-14 | - | GGAGGCCGCGCAGAGGAGAA | 20 | 1353 |
| RAD52-15 | - | GGCAGCGCGCGGUGCACACA | 20 | 1354 |
| RAD52-16 | + | GGGAGGAGAGCGGCUUCCCC | 20 | 1355 |
| RAD52-17 | - | GGGCAGCGCGCGGUGCACAC | 20 | 1356 |
| RAD52-18 | - | GGGGAAGAGAUCUUAGAUGG | 20 | 1357 |
| RAD52-19 | - | GGUGAACUAGAACAGGCCUC | 20 | 1358 |
| RAD52-20 | + | GGUGGUUCUAGCCGUGGGUG | 20 | 1359 |

Table II.41B provides exemplary targeting domains of gRNAs to be used with an eiCas9 fusion molecule (e.g., an eiCas9 fused to a transcription activator or repressor domain) to alter (e.g., activate or repress) a gene, e.g., RAD52 gene. The targeting domains of gRNAs were selected according to the second tier parameters. The targeting domains bind within 500 bp spanning a transcription start site (TSS), e.g., upstream or downstream of a TSS and have a high level of orthogonality. It is contemplated herein that in an embodiment the targeting domain hybridizes to the target domain through complementary base pairing. Any of the targeting domains in the table can be used with a S. pyogenes eiCas9 fusion molecule (e.g., an eiCas9 fused to a transcription activator or repressor domain) to alter (e.g., activate or repress) the RAD52 gene. One or more gRNA may be used to target an eiCas9 fusion molecule to a region spanning 500 bp of a transcription start site (TSS) of the RAD52 gene.

TABLE II.41B

Exemplary HDR-enhancing gRNAs Targeting a RAD52 Gene

S. pyogenes — A high level of orthogonality
41B

| 2nd Tier gRNA Name | DNA Strand | Targeting Domain | Target Site Length | Seq ID |
|---|---|---|---|---|
| RAD52-21 | - | AACCGUAAAUCAAGUCGGAG | 20 | 1360 |
| RAD52-22 | - | ACCCACGGCUAGAACCACCC | 20 | 1361 |
| RAD52-23 | + | AGCUUCCGGGUCGAGAACCU | 20 | 1362 |
| RAD52-24 | - | AGGGAGCUCGAUCUAGGCUA | 20 | 1363 |
| RAD52-25 | - | CACGGCUAGAACCACCCCGG | 20 | 1364 |
| RAD52-26 | + | CAGCUUCCGGGUCGAGAACC | 20 | 1365 |
| RAD52-27 | - | CCACGGCUAGAACCACCCCG | 20 | 1366 |

TABLE II.41B-continued

Exemplary HDR-enhancing gRNAs Targeting a RAD52 Gene

S. pyogenes — A high level of orthogonality 41B

| 2nd Tier gRNA Name | DNA Strand | Targeting Domain | Target Site Length | Seq ID |
|---|---|---|---|---|
| RAD52-28 | - | CCCACGGCUAGAACCACCCC | 20 | 1367 |
| RAD52-29 | + | CCCCGGGGUGGUUCUAGCCG | 20 | 1368 |
| RAD52-30 | + | CCCGGGGUGGUUCUAGCCGU | 20 | 1369 |
| RAD52-31 | + | CCGAGGCGCGUAAGUGGGGG | 20 | 1370 |
| RAD52-32 | - | CCUCCCCCACUUACGCGCCU | 20 | 1371 |
| RAD52-33 | - | CGCGAGCGUCUCUGGGAAGA | 20 | 1372 |
| RAD52-34 | + | CGCUGCCCGAGGCGCGUAAG | 20 | 1373 |
| RAD52-35 | - | CUCGAUCUAGGCUAUGGACA | 20 | 1374 |
| RAD52-36 | - | CUUAGAUGGAGGCCGCGCAG | 20 | 1375 |
| RAD52-37 | - | UACGCGCCUCGGGCAGCGCG | 20 | 1376 |
| RAD52-38 | - | UCCGAACCCACGCCCAGCGC | 20 | 1377 |
| RAD52-39 | - | UCGAUCUAGGCUAUGGACAA | 20 | 1378 |
| RAD52-40 | + | UGCCCGAGGCGCGUAAGUGG | 20 | 1379 |

Table II.42A provides exemplary targeting domains of gRNAs to be used with an eiCas9 fusion molecule (e.g., an eiCas9 fused to a transcription activator or repressor domain) to alter (e.g., activate or repress) a gene, e.g., RAD52 gene. The targeting domains of gRNAs were selected according to the first tier parameters. The targeting domains bind within 500 bp spanning a transcription start site (TSS), e.g., upstream or downstream of a TSS, have a high level of orthogonality, start with a 5'G and PAM is NNGRRT. It is contemplated herein that in an embodiment the targeting domain hybridizes to the target domain through complementary base pairing. Any of the targeting domains in the table can be used with a S. aureus eiCas9 fusion molecule (e.g., an eiCas9 fused to a transcription activator or repressor domain) to alter (e.g., activate or repress) the RAD52 gene. One or more gRNA may be used to target an eiCas9 fusion molecule to a region spanning 500 bp of a transcription start site (TSS) of the RAD52 gene.

Table II.42B provides exemplary targeting domains of gRNAs to be used with an eiCas9 fusion molecule (e.g., an eiCas9 fused to a transcription activator or repressor domain) to alter (e.g., activate or repress) a gene, e.g., RAD52 gene. The targeting domains of gRNAs were selected according to the second tier parameters. The targeting domains bind within 500 bp spanning a transcription start site (TSS), e.g., upstream or downstream of a TSS, have a high level of orthogonality and PAM is NNGRRT. It is contemplated herein that in an embodiment the targeting domain hybridizes to the target domain through complementary base pairing. Any of the targeting domains in the table can be used with a S. aureus eiCas9 fusion molecule (e.g., an eiCas9 fused to a transcription activator or repressor domain) to alter (e.g., activate or repress) the RAD52 gene. One or more gRNA may be used to target an eiCas9 fusion molecule to a region spanning 500 bp of a transcription start site (TSS) of the RAD52 gene.

TABLE II.42A

Exemplary HDR-enhancing gRNAs Targeting a RAD52 Gene

S. aureus — A high level of orthogonality, starts with a G, PAM is NNGRRT 42A

| 1st Tier gRNA Name | DNA Strand | Targeting Domain | Target Site Length | Seq ID |
|---|---|---|---|---|
| RAD52-41 | + | GGAGCGUGGGAAGGCUCAGCUU | 22 | 1380 |
| RAD52-42 | + | GGGGGAGGAGAGCGGCUUCCCC | 22 | 1381 |

TABLE II.42B

Exemplary HDR-enhancing gRNAs Targeting a RAD52 Gene

S. aureus — A high level of orthogonality, and PAM is NNGRRT — 42B

| 2nd Tier gRNA Name | DNA Strand | Targeting Domain | Target Site Length | Seq ID |
|---|---|---|---|---|
| RAD52-43 | − | AGGCCGCGCAGAGGAGAAUGGG | 22 | 1382 |
| RAD52-44 | − | CAGCAUCUCUACGCUGAGACCU | 22 | 1383 |
| RAD52-45 | + | CUGAGGUCUCAGCGUAGAGAUG | 22 | 1384 |
| RAD52-46 | − | CUUAGAUGGAGGCCGCGCAGAG | 22 | 1385 |
| RAD52-47 | + | UUCCCCCGGGGUGGUUCUAGCC | 22 | 1386 |
| RAD52-48 | + | UUUUCCCCUCCGGCGCUGGGC | 22 | 1387 |

Table II.43A provides exemplary targeting domains of gRNAs to be used with an eiCas9 fusion molecule (e.g., an eiCas9 fused to a transcription activator or repressor domain) to alter (e.g., activate or repress) a gene, e.g., ERCC1 gene. The targeting domains of gRNAs were selected according to the first tier parameters. The targeting domains bind within 500 bp spanning a transcription start site (TSS), e.g., upstream or downstream of a TSS, have a high level of orthogonality and start with a 5'G. It is contemplated herein that in an embodiment the targeting domain hybridizes to the target domain through complementary base pairing. Any of the targeting domains in the table can be used with a S. pyogenes eiCas9 fusion molecule (e.g., an eiCas9 fused to a transcription activator or repressor domain) to alter (e.g., activate or repress) the ERCC1 gene. One or more gRNA may be used to target an eiCas9 fusion molecule to a region spanning 500 bp of a transcription start site (TSS) of the ERCC1 gene.

TABLE II.43A

Exemplary HDR-enhancing gRNAs Targeting a ERCC1 Gene

S. pyogenes — A high level of orthogonality, and starts with a G — 43A

| 1st Tier gRNA Name | DNA Strand | Targeting Domain | Target Site Length | Seq ID |
|---|---|---|---|---|
| ERCC1-1 | − | GAAAGACUGCAGAGGGAUCG | 20 | 1388 |
| ERCC1-2 | + | GAGCCAAUAGAAUCCGGUGG | 20 | 1389 |
| ERCC1-3 | + | GCACGGACUCGCACAGGACC | 20 | 1390 |
| ERCC1-4 | + | GCCGGAAGUGCUGCGAGCCC | 20 | 1391 |
| ERCC1-5 | + | GCCGGACGAACGGAAGGCGG | 20 | 1392 |
| ERCC1-6 | + | GCCUCUAGCGCUGGGUGUUG | 20 | 1393 |
| ERCC1-7 | + | GCGCGUGGGGGGAAUAGGUG | 20 | 1394 |
| ERCC1-8 | + | GCGGGUGGAGAUUGGCGCCG | 20 | 1395 |
| ERCC1-9 | + | GCGUCCAGAUGCUAGCCUCG | 20 | 1396 |
| ERCC1-10 | − | GGAGAUCCCGGGAGAGCCGU | 20 | 1397 |
| ERCC1-11 | + | GGAGCCAAUAGAAUCCGGUG | 20 | 1398 |
| ERCC1-12 | + | GGCCGGACGAACGGAAGGCG | 20 | 1399 |
| ERCC1-13 | + | GGCGCUGAAACCGUGAGGCC | 20 | 1400 |
| ERCC1-14 | + | GGCGUCCAGAUGCUAGCCUC | 20 | 1401 |
| ERCC1-15 | + | GGCUUUGAAACUUAACAGUU | 20 | 1402 |
| ERCC1-16 | − | GGGAGAUCCCGGGAGAGCCG | 20 | 1403 |
| ERCC1-17 | + | GGGCCGGACGAACGGAAGGC | 20 | 1404 |
| ERCC1-18 | + | GGGCGUCCAGAUGCUAGCCU | 20 | 1405 |

TABLE II.43A-continued

Exemplary HDR-enhancing gRNAs Targeting a ERCC1 Gene

S. pyogenes — A high level of orthogonality, and starts with a G
43A

| 1st Tier gRNA Name | DNA Strand | Targeting Domain | Target Site Length | Seq ID |
|---|---|---|---|---|
| ERCC1-19 | − | GGUCCUGUGCGAGUCCGUGC | 20 | 1406 |
| ERCC1-20 | + | GUUACAGAGCCUCUAGCGCU | 20 | 1407 |

Table II.43B provides exemplary targeting domains of gRNAs to be used with an eiCas9 fusion molecule (e.g., an eiCas9 fused to a transcription activator or repressor domain) to alter (e.g., activate or repress) a gene, e.g., ERCC1 gene. The targeting domains of gRNAs were selected according to the second tier parameters. The targeting domains bind within 500 bp spanning a transcription start site (TSS), e.g., upstream or downstream of a TSS and have a high level of orthogonality. It is contemplated herein that in an embodiment the targeting domain hybridizes to the target domain through complementary base pairing. Any of the targeting domains in the table can be used with a S. pyogenes eiCas9 fusion molecule (e.g., an eiCas9 fused to a transcription activator or repressor domain) to alter (e.g., activate or repress) the ERCC1 gene. One or more gRNA may be used to target an eiCas9 fusion molecule to a region spanning 500 bp of a transcription start site (TSS) of the ERCC1 gene.

TABLE II.43B

Exemplary HDR-enhancing gRNAs Targeting a ERCC1 Gene

S. pyogenes — A high level of orthogonality
43B

| 2nd Tier gRNA Name | DNA Strand | Targeting Domain | Target Site Length | Seq ID |
|---|---|---|---|---|
| ERCC1-21 | + | ACGGAGCCAAUAGAAUCCGG | 20 | 1408 |
| ERCC1-22 | − | AGAUCGCAGGAGAUCCAACU | 20 | 1409 |
| ERCC1-23 | + | AGCCUCGGGGCCGGACGAA | 20 | 1410 |
| ERCC1-24 | + | AGCCUCUAGCGCUGGGUGUU | 20 | 1411 |
| ERCC1-25 | + | AUAGAAUCCGGUGGGGGCGA | 20 | 1412 |
| ERCC1-26 | − | CCGGAGCUUACGGUUCAGUA | 20 | 1413 |
| ERCC1-27 | + | CGGAGCCAAUAGAAUCCGGU | 20 | 1414 |
| ERCC1-28 | + | CGUCCAGAUGCUAGCCUCGG | 20 | 1415 |
| ERCC1-29 | + | CGUUACAGAGCCUCUAGCGC | 20 | 1416 |
| ERCC1-30 | − | CUACGUUCUCAUCCCGCAGC | 20 | 1417 |
| ERCC1-31 | − | CUCACGGUUUCAGCGCCGCG | 20 | 1418 |
| ERCC1-32 | + | CUCGCGGCGCUGAAACCGUG | 20 | 1419 |
| ERCC1-33 | + | UCACCAGCACGGACUCGCAC | 20 | 1420 |
| ERCC1-34 | − | UCCCCCGCCUUCCGUUCGUC | 20 | 1421 |
| ERCC1-35 | − | UCCGAGAGCUCCAUAGCGUC | 20 | 1422 |
| ERCC1-36 | − | UCGCCCCACCGGAUUCUAU | 20 | 1423 |
| ERCC1-37 | − | UCGGCAAUGAUUGGCUUCCG | 20 | 1424 |

TABLE II.43B-continued

Exemplary HDR-enhancing gRNAs Targeting a ERCC1 Gene

S. pyogenes — A high level of orthogonality 43B

| 2nd Tier gRNA Name | DNA Strand | Targeting Domain | Target Site Length | Seq ID |
|---|---|---|---|---|
| ERCC1-38 | + | UCGGGGGCCGGACGAACGGA | 20 | 1425 |
| ERCC1-39 | − | UGGAGGACCGCGGAGGUCGU | 20 | 1426 |
| ERCC1-40 | − | UUCCGUUCGUCCGGCCCCCG | 20 | 1427 |

Table II.44A provides exemplary targeting domains of gRNAs to be used with an eiCas9 fusion molecule (e.g., an eiCas9 fused to a transcription activator or repressor domain) to alter (e.g., activate or repress) a gene, e.g., ERCC1 gene. The targeting domains of gRNAs were selected according to the first tier parameters. The targeting domains bind within 500 bp spanning a transcription start site (TSS), e.g., upstream or downstream of a TSS, have a high level of orthogonality, start with a 5'G and PAM is NNGRRT. It is contemplated herein that in an embodiment the targeting domain hybridizes to the target domain through complementary base pairing. Any of the targeting domains in the table can be used with a S. aureus eiCas9 fusion molecule (e.g., an eiCas9 fused to a transcription activator or repressor domain) to alter (e.g., activate or repress) the ERCC1 gene. One or more gRNA may be used to target an eiCas9 fusion molecule to a region spanning 500 bp of a transcription start site (TSS) of the ERCC1 gene.

TABLE II.44A

Exemplary HDR-enhancing gRNAs Targeting a ERCC1 Gene

S. aureus — A high level of orthogonality, starts with a G, PAM is NNGRRT 44A

| 1st Tier gRNA Name | DNA Strand | Targeting Domain | Target Site Length | Seq ID |
|---|---|---|---|---|
| ERCC1-41 | + | GAAACUGAAGCCAAGUCAAUGU | 22 | 1428 |
| ERCC1-42 | + | GAAGCCCUUCCGGACUCCGGGG | 22 | 1429 |
| ERCC1-43 | + | GACCCCCAUCCCACGGCUCUCC | 22 | 1430 |
| ERCC1-44 | − | GAUCCCGGGAGAGCCGUGGGAU | 22 | 1431 |
| ERCC1-45 | + | GCGCCGCGGAAGCCAAUCAUUG | 22 | 1432 |
| ERCC1-46 | − | GCUGACCCAGAAUGGGCAGGUC | 22 | 1433 |
| ERCC1-47 | + | GGAAUAGGUGUGGAAUAAAUGA | 22 | 1434 |
| ERCC1-48 | + | GGACCUGACGCUAUGGAGCUCU | 22 | 1435 |
| ERCC1-49 | + | GGGAAGAGAGGAAGCGCGUGGG | 22 | 1436 |
| ERCC1-50 | + | GGGAUGGUGGGGACGGAGCCAA | 22 | 1437 |
| ERCC1-51 | + | GGGGCCGGACGAACGGAAGGCG | 22 | 1438 |
| ERCC1-52 | − | GGGGGAGCGCCUGACUCAGCCC | 22 | 1439 |
| ERCC1-53 | + | GGGGGGAAUAGGUGUGGAAUAA | 22 | 1440 |

Table II.44B provides exemplary targeting domains of gRNAs to be used with an eiCas9 fusion molecule (e.g., an eiCas9 fused to a transcription activator or repressor domain) to alter (e.g., activate or repress) a gene, e.g., ERCC1 gene. The targeting domains of gRNAs were selected according to the second tier parameters. The targeting domains bind within 500 bp spanning a transcription start site (TSS), e.g., upstream or downstream of a TSS, have a high level of orthogonality and PAM is NNGRRT. It is contemplated herein that in an embodiment the targeting domain hybridizes to the target domain through complementary base pairing. Any of the targeting domains in the table can be used with a *S. aureus* eiCas9 fusion molecule (e.g., an eiCas9 fused to a transcription activator or repressor domain) to alter (e.g., activate or repress) the ERCC1 gene. One or more gRNA may be used to target an eiCas9 fusion molecule to a region spanning 500 bp of a transcription start site (TSS) of the ERCC1 gene.

Table II.45A provides exemplary targeting domains of gRNAs to be used with an eiCas9 fusion molecule (e.g., an eiCas9 fused to a transcription activator or repressor domain) to alter (e.g., activate or repress) a gene, e.g., ERCC4 gene. The targeting domains of gRNAs were selected according to the first tier parameters. The targeting domains bind within 500 bp spanning a transcription start site (TSS), e.g., upstream or downstream of a TSS, have a high level of orthogonality and start with a 5'G. It is contemplated herein that in an embodiment the targeting domain hybridizes to the target domain through complementary base pairing. Any of the targeting domains in the table can be used with a *S. pyogenes* eiCas9 fusion molecule (e.g., an eiCas9 fused to a transcription activator or repressor domain) to alter (e.g., activate or repress) the ERCC4 gene. One or more gRNA may be used to target an eiCas9 fusion molecule to a region spanning 500 bp of a transcription start site (TSS) of the ERCC4 gene.

TABLE II.44B

Exemplary HDR-enhancing gRNAs Targeting a ERCC1 Gene

A high level of orthogonality, and PAM is NNGRRT

*S. aureus* 44B

| 2nd Tier gRNA Name | DNA Strand | Targeting Domain | Target Site Length | Seq ID |
|---|---|---|---|---|
| ERCC1-54 | + | AAGCGCGUGGGGGGAAUAGGUG | 22 | 1441 |
| ERCC1-55 | + | ACAGGUGCGGGAGGCGGAGACU | 22 | 1442 |
| ERCC1-56 | − | AGACACGUUCCCAGUGCUGACC | 22 | 1443 |
| ERCC1-57 | − | AGCCUCAAGGGAAAGACUGCAG | 22 | 1444 |
| ERCC1-58 | − | AUCGCUCCGCCCCUCGCCCCCA | 22 | 1445 |
| ERCC1-59 | − | AUGGGAGAUCCCGGGAGAGCCG | 22 | 1446 |
| ERCC1-60 | − | CCUCUCUGGCCCCGCUCCCCAG | 22 | 1447 |
| ERCC1-61 | + | CGGAGUUUUGUGGGGACGGCU | 22 | 1448 |
| ERCC1-62 | − | CUCAGUAAGGAGAGACUUAAGU | 22 | 1449 |
| ERCC1-63 | + | CUUACUGAGAGGAGGGACCAAG | 22 | 1450 |
| ERCC1-64 | − | CUUCCUCUCUUCCCGGUCCUGU | 22 | 1451 |
| ERCC1-65 | + | UCCCAUCCCAGACCUGCCCAUU | 22 | 1452 |
| ERCC1-66 | + | UCCGCGGUCCUCCAGAACCAUA | 22 | 1453 |
| ERCC1-67 | + | UCUGUUCUCCACUGAGCCCUGC | 22 | 1454 |
| ERCC1-68 | + | UGAAGCCAAGUCAAUGUCUGAG | 22 | 1455 |
| ERCC1-69 | + | UGGCGUUACAGAGCCUCUAGCG | 22 | 1456 |
| ERCC1-70 | − | UGGGAGGAGAGAUGUGGCCU | 22 | 1457 |
| ERCC1-71 | + | UGUGAGUGGGGGGUUCCUGCUG | 22 | 1458 |
| ERCC1-72 | − | UUACUGAGCGCUUCUGUGUGCC | 22 | 1459 |
| ERCC1-73 | + | UUGUGGGGACGGCUGUGAGUG | 22 | 1460 |

TABLE II.45A

Exemplary HDR-enhancing gRNAs Targeting a ERCC4 Gene

| S. pyogenes | A high level of orthogonality, and starts with a G 45A | | | |
|---|---|---|---|---|
| 1st Tier gRNA Name | DNA Strand | Targeting Domain | Target Site Length | Seq ID |
| ERCC4-1 | + | GAAGAGCUUCCAUGGAGUCA | 20 | 1461 |
| ERCC4-2 | − | GACUCCAUGGAAGCUCUUCC | 20 | 1462 |
| ERCC4-3 | − | GAGAGCCGAGUCCGAGAGGA | 20 | 1463 |
| ERCC4-4 | + | GAUUGCCAUGGCGCCGCUGC | 20 | 1464 |
| ERCC4-5 | − | GCCAUGGCAAUCCGUCGAGC | 20 | 1465 |
| ERCC4-6 | − | GCCGACUCCUAGUGGAGAGU | 20 | 1466 |
| ERCC4-7 | + | GCCGGCUCGACGGAUUGCCA | 20 | 1467 |
| ERCC4-8 | + | GCCUACUCUCCACUAGGAGU | 20 | 1468 |
| ERCC4-9 | + | GCGACCCGGAAGAGCUUCCA | 20 | 1469 |
| ERCC4-10 | + | GCUGGAGUACGAGCGACAGC | 20 | 1470 |
| ERCC4-11 | + | GGAAGAGCUUCCAUGGAGUC | 20 | 1471 |
| ERCC4-12 | + | GGCUGCCGUCCUCUCGGACU | 20 | 1472 |
| ERCC4-13 | + | GGCUGCGUUCGGCUGCGACC | 20 | 1473 |
| ERCC4-14 | + | GUACGAGCGACAGCUGGUGC | 20 | 1474 |
| ERCC4-15 | − | GUACUCCAGCAGCGGCGCCA | 20 | 1475 |

Table II.45B provides exemplary targeting domains of gRNAs to be used with an eiCas9 fusion molecule (e.g., an eiCas9 fused to a transcription activator or repressor domain) to alter (e.g., activate or repress) a gene, e.g., ERCC4 gene. The targeting domains of gRNAs were selected according to the second tier parameters. The targeting domains bind within 500 bp spanning a transcription start site (TSS), e.g., upstream or downstream of a TSS and have a high level of orthogonality. It is contemplated herein that in an embodiment the targeting domain hybridizes to the target domain through complementary base pairing. Any of the targeting domains in the table can be used with a S. pyogenes eiCas9 fusion molecule (e.g., an eiCas9 fused to a transcription activator or repressor domain) to alter (e.g., activate or repress) the ERCC4 gene. One or more gRNA may be used to target an eiCas9 fusion molecule to a region spanning 500 bp of a transcription start site (TSS) of the ERCC4 gene.

TABLE II.45B

Exemplary HDR-enhancing gRNAs Targeting a ERCC4 Gene

| S. pyogenes | A high level of orthogonality 45B | | | |
|---|---|---|---|---|
| 2nd Tier gRNA Name | DNA Strand | Targeting Domain | Target Site Length | Seq ID |
| ERCC4-16 | − | AGCCGGCUGCCCUGACUCCA | 20 | 1476 |
| ERCC4-17 | + | AGUCAGGGCAGCCGGCUCGA | 20 | 1477 |

TABLE II.45B-continued

Exemplary HDR-enhancing gRNAs Targeting a ERCC4 Gene

S. pyogenes    A high level of orthogonality
               45B

| 2nd Tier gRNA Name | DNA Strand | Targeting Domain | Target Site Length | Seq ID |
|---|---|---|---|---|
| ERCC4-18 | + | AGUUCGGCCUACUCUCCACU | 20 | 1478 |
| ERCC4-19 | + | CACUAGGAGUCGGCUUCCUU | 20 | 1479 |
| ERCC4-20 | − | CGAAGAGAGCCGAGUCCGAG | 20 | 1480 |
| ERCC4-21 | − | CGAAGGAAGCCGACUCCUAG | 20 | 1481 |
| ERCC4-22 | + | CGGCUCUCUUCGGUUGAGUU | 20 | 1482 |
| ERCC4-23 | + | CGGCUUCCUUCGGCUGCGUU | 20 | 1483 |
| ERCC4-24 | + | CUCUCGGACUCGGCUCUCUU | 20 | 1484 |
| ERCC4-25 | + | CUGGAACUGCUCGACACUGA | 20 | 1485 |
| ERCC4-26 | − | UCGCAGCCGAACGCAGCCGA | 20 | 1486 |
| ERCC4-27 | + | UCGGCUGGCUGCCGUCCUCU | 20 | 1487 |
| ERCC4-28 | − | UGACUCCAUGGAAGCUCUUC | 20 | 1488 |
| ERCC4-29 | + | UGGAACUGCUCGACACUGAC | 20 | 1489 |
| ERCC4-30 | − | UGUCGCUCGUACUCCAGCAG | 20 | 1490 |
| ERCC4-31 | + | UUCCAUGGAGUCAGGGCAGC | 20 | 1491 |

Table II.46A provides exemplary targeting domains of gRNAs to be used with an eiCas9 fusion molecule (e.g., an eiCas9 fused to a transcription activator or repressor domain) to alter (e.g., activate or repress) a gene, e.g., ERCC4 gene. The targeting domains of gRNAs were selected according to the first tier parameters. The targeting domains bind within 500 bp spanning a transcription start site (TSS), e.g., upstream or downstream of a TSS, have a high level of orthogonality, start with a 5'G and PAM is NNGRRT. It is contemplated herein that in an embodiment the targeting domain hybridizes to the target domain through complementary base pairing. Any of the targeting domains in the table can be used with a S. aureus eiCas9 fusion molecule (e.g., an eiCas9 fused to a transcription activator or repressor domain) to alter (e.g., activate or repress) the ERCC4 gene. One or more gRNA may be used to target an eiCas9 fusion molecule to a region spanning 500 bp of a transcription start site (TSS) of the ERCC4 gene.

Table II.46B provides exemplary targeting domains of gRNAs to be used with an eiCas9 fusion molecule (e.g., an eiCas9 fused to a transcription activator or repressor domain) to alter (e.g., activate or repress) a gene, e.g., ERCC4 gene. The targeting domains of gRNAs were selected according to the second tier parameters. The targeting domains bind within 500 bp spanning a transcription start site (TSS), e.g., upstream or downstream of a TSS, have a high level of orthogonality and PAM is NNGRRT. It is contemplated herein that in an embodiment the targeting domain hybridizes to the target domain through complementary base pairing. Any of the targeting domains in the table can be used with a S. aureus eiCas9 fusion molecule (e.g., an eiCas9 fused to a transcription activator or repressor domain) to alter (e.g., activate or repress) the ERCC4 gene. One or more gRNA may be used to target an eiCas9 fusion molecule to a region spanning 500 bp of a transcription start site (TSS) of the ERCC4 gene.

TABLE II.46A

Exemplary HDR-enhancing gRNA Targeting a ERCC4 Gene

S. aureus    A high level of orthogonality,
             starts with a G, PAM is NNGRRT
             46A

| 1st Tier gRNA Name | DNA Strand | Targeting Domain | Target Site Length | Seq ID |
|---|---|---|---|---|
| ERCC4-32 | − | GGCCGAACUCAACCGAAGAGAG | 22 | 1492 |

TABLE II.46B

Exemplary HDR-enhancing gRNAs Targeting a ERCC4 Gene

| S. aureus | A high level of orthogonality, and PAM is NNGRRT 46B | | | |
|---|---|---|---|---|
| 2nd Tier gRNA Name | DNA Strand | Targeting Domain | Target Site Length | Seq ID |
| ERCC4-33 | − | CCCUGACUCCAUGGAAGCUCUU | 22 | 1493 |
| ERCC4-34 | − | CGAAGGAAGCCGACUCCUAGUG | 22 | 1494 |
| ERCC4-35 | + | CGGAUUGCCAUGGCGCCGCUGC | 22 | 1495 |
| ERCC4-36 | + | CUGCGACCCGGAAGAGCUUCCA | 22 | 1496 |
| ERCC4-37 | + | UCUCGGACUCGGCUCUCUUCGG | 22 | 1497 |
| ERCC4-38 | + | UGAGUUCGGCCUACUCUCCACU | 22 | 1498 |
| ERCC4-39 | + | UGGAGUCAGGGCAGCCGGCUCG | 22 | 1499 |

Table II.47A provides exemplary targeting domains of gRNAs to be used with an eiCas9 fusion molecule (e.g., an eiCas9 fused to a transcription activator or repressor domain) to alter (e.g., activate or repress) a gene, e.g., PARP1 gene. The targeting domains of gRNAs were selected according to the first tier parameters. The targeting domains bind within 500 bp spanning a transcription start site (TSS), e.g., upstream or downstream of a TSS, have a high level of orthogonality and start with a 5'G. It is contemplated herein that in an embodiment the targeting domain hybridizes to the target domain through complementary base pairing. Any of the targeting domains in the table can be used with a S. pyogenes eiCas9 fusion molecule (e.g., an eiCas9 fused to a transcription activator or repressor domain) to alter (e.g., activate or repress) the PARP1 gene. One or more gRNA may be used to target an eiCas9 fusion molecule to a region spanning 500 bp of a transcription start site (TSS) of the PARP1 gene.

TABLE II.47A

Exemplary HDR-enhancing gRNAs Targeting a PARP1 Gene

| S. pyogenes | A high level of orthogonality, and starts with a G 47A | | | |
|---|---|---|---|---|
| 1st Tier gRNA Name | DNA Strand | Targeting Domain | Target Site Length | Seq ID |
| PARP1-1 | − | GAACCCGCGUCCACGGGGCG | 20 | 1500 |
| PARP1-2 | − | GAUUGCUGAUGCCUGGCCGC | 20 | 1501 |
| PARP1-3 | + | GCAGGGGCGCGCGCGCCGC | 20 | 1502 |
| PARP1-4 | − | GCCCACGGAACCCGCGUCCA | 20 | 1503 |
| PARP1-5 | − | GCCCCUGCCGGCCGGGGGG | 20 | 1504 |
| PARP1-6 | + | GCCGCUCAGGCGCCUGCGGC | 20 | 1505 |
| PARP1-7 | + | GCGCACGCGAGGCGGCGAGG | 20 | 1506 |
| PARP1-8 | + | GCGCCGCCGGCCCCGCCCCG | 20 | 1507 |
| PARP1-9 | − | GCGCGCCCCUGCCGGCCGG | 20 | 1508 |
| PARP1-10 | − | GCGCGCGCCCCUGCCGGCC | 20 | 1509 |
| PARP1-11 | − | GCGGCGCGCGCGCCCCCUGC | 20 | 1510 |
| PARP1-12 | − | GCGUGCGCUCACCCAGCCGC | 20 | 1511 |
| PARP1-13 | − | GGAACCCGCGUCCACGGGGC | 20 | 1512 |
| PARP1-14 | + | GGCAGCGUGUUUCUAGGUCG | 20 | 1513 |
| PARP1-15 | + | GGCCGGUGCGGCGUGUUCGG | 20 | 1514 |
| PARP1-16 | + | GGCGUGUUCGGUGGCGGCUC | 20 | 1515 |

TABLE II.47A-continued

Exemplary HDR-enhancing gRNAs Targeting a PARP1 Gene

| S. pyogenes | | A high level of orthogonality, and starts with a G 47A | | |
|---|---|---|---|---|
| 1st Tier gRNA Name | DNA Strand | Targeting Domain | Target Site Length | Seq ID |
| PARP1-17 | + | GGGAACGGCGGUGGCCGGUG | 20 | 1516 |
| PARP1-18 | + | GGGUUCCGUGGGCGUUCCCG | 20 | 1517 |
| PARP1-19 | + | GGUGGCCGGUGCGGCGUGUU | 20 | 1518 |
| PARP1-20 | + | GGUGGCGGCUCUGGCCGCUC | 20 | 1519 |

Table II.47B provides exemplary targeting domains of gRNAs to be used with an eiCas9 fusion molecule (e.g., an eiCas9 fused to a transcription activator or repressor domain) to alter (e.g., activate or repress) a gene, e.g., PARP1 gene. The targeting domains of gRNAs were selected according to the second tier parameters. The targeting domains bind within 500 bp spanning a transcription start site (TSS), e.g., upstream or downstream of a TSS and have a high level of orthogonality. It is contemplated herein that in an embodiment the targeting domain hybridizes to the target domain through complementary base pairing. Any of the targeting domains in the table can be used with a *S. pyogenes* eiCas9 fusion molecule (e.g., an eiCas9 fused to a transcription activator or repressor domain) to alter (e.g., activate or repress) the PARP1 gene. One or more gRNA may be used to target an eiCas9 fusion molecule to a region spanning 500 bp of a transcription start site (TSS) of the PARP1 gene.

TABLE II.47B

Exemplary HDR-enhancing gRNAs Targeting a PARP1 Gene

| S. pyogenes | | A high level of orthogonality 47B | | |
|---|---|---|---|---|
| 2nd Tier gRNA Name | DNA Strand | Targeting Domain | Target Site Length | Seq ID |
| PARP1-21 | + | AACUCCGCCCCCGGCCGGC | 20 | 1520 |
| PARP1-22 | + | AAUCUAUCAGGGAACGGCGG | 20 | 1521 |
| PARP1-23 | + | ACUCCGCCCCCGGCCGGCA | 20 | 1522 |
| PARP1-24 | + | AGCAAUCUAUCAGGGAACGG | 20 | 1523 |
| PARP1-25 | − | CCACGGAACCCGCGUCCACG | 20 | 1524 |
| PARP1-26 | − | CCCACGGAACCCGCGUCCAC | 20 | 1525 |
| PARP1-27 | + | CCCCGUGGACGCGGGUUCCG | 20 | 1526 |
| PARP1-28 | + | CCCGUGGACGCGGGUUCCGU | 20 | 1527 |
| PARP1-29 | + | CCGCUCAGGCGCCUGCGGCU | 20 | 1528 |
| PARP1-30 | + | CCGUGGGCGUUCCCGCGGCC | 20 | 1529 |
| PARP1-31 | − | CCUGAUAGAUUGCUGAUGCC | 20 | 1530 |
| PARP1-32 | − | CCUGGCCGCGGGAACGCCCA | 20 | 1531 |
| PARP1-33 | + | CGAGGCGGCAGCGUGUUUCU | 20 | 1532 |
| PARP1-34 | − | CGCCACCGAACACGCCGCAC | 20 | 1533 |
| PARP1-35 | − | CGGAACCCGCGUCCACGGGG | 20 | 1534 |
| PARP1-36 | + | CGGCUGGGUGAGCGCACGCG | 20 | 1535 |
| PARP1-37 | + | CGGUGCGGCGUGUUCGGUGG | 20 | 1536 |
| PARP1-38 | + | CUGGGUGAGCGCACGCGAGG | 20 | 1537 |

TABLE II.47B-continued

Exemplary HDR-enhancing gRNAs Targeting a PARP1 Gene

S. pyogenes — A high level of orthogonality 47B

| 2nd Tier gRNA Name | DNA Strand | Targeting Domain | Target Site Length | Seq ID |
|---|---|---|---|---|
| PARP1-39 | + | UAUCAGGGAACGGCGGUGGC | 20 | 1538 |
| PARP1-40 | + | UGAGCGCACGCGAGGCGGCG | 20 | 1539 |

Table II.48A provides exemplary targeting domains of gRNAs to be used with an eiCas9 fusion molecule (e.g., an eiCas9 fused to a transcription activator or repressor domain) to alter (e.g., activate or repress) a gene, e.g., PARP1 gene. The targeting domains of gRNAs were selected according to the first tier parameters. The targeting domains bind within 500 bp spanning a transcription start site (TSS), e.g., upstream or downstream of a TSS, have a high level of orthogonality, start with a 5'G and PAM is NNGRRT. It is contemplated herein that in an embodiment the targeting domain hybridizes to the target domain through complementary base pairing. Any of the targeting domains in the table can be used with a S. aureus eiCas9 fusion molecule (e.g., an eiCas9 fused to a transcription activator or repressor domain) to alter (e.g., activate or repress) the PARP1 gene. One or more gRNA may be used to target an eiCas9 fusion molecule to a region spanning 500 bp of a transcription start site (TSS) of the PARP1 gene.

TABLE II.48A

Exemplary HDR-enhancing gRNA Targeting a PARP1 Gene

S. aureus — A high level of orthogonality, starts with a G, PAM is NNGRRT 48A

| 1st Tier gRNA Name | DNA Strand | Targeting Domain | Target Site Length | Seq ID |
|---|---|---|---|---|
| PARP1-41 | − | GCGCCCCUGCCGGCCGGGGGG | 22 | 1540 |

Table II.48B provides exemplary targeting domains of gRNAs to be used with an eiCas9 fusion molecule (e.g., an eiCas9 fused to a transcription activator or repressor domain) to alter (e.g., activate or repress) a gene, e.g., PARP1 gene. The targeting domains of gRNAs were selected according to the second tier parameters. The targeting domains bind within 500 bp spanning a transcription start site (TSS), e.g., upstream or downstream of a TSS, have a high level of orthogonality and PAM is NNGRRT. It is contemplated herein that in an embodiment the targeting domain hybridizes to the target domain through complementary base pairing. Any of the targeting domains in the table can be used with a S. aureus eiCas9 fusion molecule (e.g., an eiCas9 fused to a transcription activator or repressor domain) to alter (e.g., activate or repress) the PARP1 gene. One or more gRNA may be used to target an eiCas9 fusion molecule to a region spanning 500 bp of a transcription start site (TSS) of the PARP1 gene.

TABLE II.48B

Exemplary HDR-enhancing gRNAs Targeting a PARP1 Gene

S. aureus — A high level of orthogonality, and PAM is NNGRRT 48B

| 2nd Tier gRNA Name | DNA Strand | Targeting Domain | Target Site Length | Seq ID |
|---|---|---|---|---|
| PARP1-42 | + | CCGCCGGCCCCGCCCCGUGGAC | 22 | 1541 |
| PARP1-43 | + | CUGGCCGCUCAGGCGCCUGCGG | 22 | 1542 |

Table II.49A provides exemplary targeting domains of gRNAs to be used with an eiCas9 fusion molecule (e.g., an eiCas9 fused to a transcription activator or repressor domain) to alter (e.g., activate or repress) a gene, e.g., BRCA1 gene. The targeting domains of gRNAs were selected according to the first tier parameters. The targeting domains bind within 500 bp spanning a transcription start site (TSS), e.g., upstream or downstream of a TSS, have a high level of orthogonality and start with a 5'G. It is contemplated herein that in an embodiment the targeting domain hybridizes to the target domain through complementary base pairing. Any of the targeting domains in the table can be used with a *S. pyogenes* eiCas9 fusion molecule (e.g., an eiCas9 fused to a transcription activator or repressor domain) to alter (e.g., activate or repress) the BRCA1 gene. One or more gRNA may be used to target an eiCas9 fusion molecule to a region spanning 500 bp of a transcription start site (TSS) of the BRCA1 gene.

Table II.49B provides exemplary targeting domains of gRNAs to be used with an eiCas9 fusion molecule (e.g., an eiCas9 fused to a transcription activator or repressor domain) to alter (e.g., activate or repress) a gene, e.g., BRCA1 gene. The targeting domains of gRNAs were selected according to the second tier parameters. The targeting domains bind within 500 bp spanning a transcription start site (TSS), e.g., upstream or downstream of a TSS and have a high level of orthogonality. It is contemplated herein that in an embodiment the targeting domain hybridizes to the target domain through complementary base pairing. Any of the targeting domains in the table can be used with a *S. pyogenes* eiCas9 fusion molecule (e.g., an eiCas9 fused to a transcription activator or repressor domain) to alter (e.g., activate or repress) the BRCA1 gene. One or more gRNA may be used to target an eiCas9 fusion molecule to a region spanning 500 bp of a transcription start site (TSS) of the BRCA1 gene.

TABLE II.49A

Exemplary HDR-enhancing gRNAs Targeting a BRCA1 Gene

*S. pyogenes*: A high level of orthogonality, and starts with a G 49A

| 1st Tier gRNA Name | DNA Strand | Targeting Domain | Target Site Length | Seq ID |
|---|---|---|---|---|
| BRCA1-1 | − | GAAAGAGCCAAGCGUCUCUC | 20 | 1543 |
| BRCA1-2 | + | GAGGCCUUCACCCUCUGCUC | 20 | 1544 |
| BRCA1-3 | + | GAGUCCCGGGAAAGGGACAG | 20 | 1545 |
| BRCA1-4 | + | GAUGCUCUGGGGUACUGGCG | 20 | 1546 |
| BRCA1-5 | + | GCUCGCUGAGACUUCCUGGA | 20 | 1547 |
| BRCA1-6 | + | GCUGCUUAGCGGUAGCCCCU | 20 | 1548 |
| BRCA1-7 | − | GGGCCCCCUGUCCCUUUCCC | 20 | 1549 |
| BRCA1-8 | + | GGGGCCCAAGUGAUGCUCUG | 20 | 1550 |
| BRCA1-9 | + | GGGGGCCCAAGUGAUGCUCU | 20 | 1551 |
| BRCA1-10 | + | GGGGUACUGGCGUGGGAGAG | 20 | 1552 |
| BRCA1-11 | + | GGGUAAAGGUAGUAGAGUCC | 20 | 1553 |
| BRCA1-12 | + | GGUAAAGGUAGUAGAGUCCC | 20 | 1554 |
| BRCA1-13 | − | GGUACAAUCAGAGGAUGGGA | 20 | 1555 |
| BRCA1-14 | + | GGUAGUAGAGUCCCGGGAAA | 20 | 1556 |
| BRCA1-15 | − | GGUGAAGGCCUCCUGAGCGC | 20 | 1557 |
| BRCA1-16 | − | GUGAAGGCCUCCUGAGCGCA | 20 | 1558 |
| BRCA1-17 | + | GUGAGCUCGCUGAGACUUCC | 20 | 1559 |
| BRCA1-18 | + | GUGGGGUUUCUCAGAUAACU | 20 | 1560 |

TABLE II.49B

Exemplary HDR-enhancing gRNAs Targeting a BRCA1 Gene

| S. pyogenes | | A high level of orthogonality 49B | | |
|---|---|---|---|---|
| 2nd Tier gRNA Name | DNA Strand | Targeting Domain | Target Site Length | Seq ID |
| BRCA1-19 | − | AAAGAGCCAAGCGUCUCUCG | 20 | 1561 |
| BRCA1-20 | + | AAAUUAAAACUGCGACUGCG | 20 | 1562 |
| BRCA1-21 | + | ACGUCAUCCGGGGCAGACU | 20 | 1563 |
| BRCA1-22 | − | CCAAGCGUCUCUCGGGCUC | 20 | 1564 |
| BRCA1-23 | + | CCCCUUGGUUUCCGUGGCAA | 20 | 1565 |
| BRCA1-24 | − | CCCGCGCUUUUCCGUUGCCA | 20 | 1566 |
| BRCA1-25 | + | CCGUGGCAACGGAAAAGCGC | 20 | 1567 |
| BRCA1-26 | − | CCGUUGCCACGGAAACCAAG | 20 | 1568 |
| BRCA1-27 | − | CCUCUCAGAAUACGAAAUCA | 20 | 1569 |
| BRCA1-28 | − | CGAAAUCAAGGUACAAUCAG | 20 | 1570 |
| BRCA1-29 | + | CGGUAGCCCCUUGGUUUCCG | 20 | 1571 |
| BRCA1-30 | − | CUGCCCCCGGAUGACGUAAA | 20 | 1572 |
| BRCA1-31 | + | CUUUCCUUUUACGUCAUCCG | 20 | 1573 |
| BRCA1-32 | + | UACGUCAUCCGGGGCAGAC | 20 | 1574 |
| BRCA1-33 | + | UCAUCCGGGGCAGACUGGG | 20 | 1575 |
| BRCA1-34 | + | UCCGUGGCAACGGAAAAGCG | 20 | 1576 |
| BRCA1-35 | − | UCCGUUGCCACGGAAACCAA | 20 | 1577 |
| BRCA1-36 | + | UCUUUCCUUUUACGUCAUCC | 20 | 1578 |
| BRCA1-37 | − | UUCCGUUGCCACGGAAACCA | 20 | 1579 |
| BRCA1-38 | + | UUUCCUUUUACGUCAUCCGG | 20 | 1580 |

Table II.50A provides exemplary targeting domains of gRNAs to be used with an eiCas9 fusion molecule (e.g., an eiCas9 fused to a transcription activator or repressor domain) to alter (e.g., activate or repress) a gene, e.g., BRCA1 gene. The targeting domains of gRNAs were selected according to the first tier parameters. The targeting domains bind within 500 bp spanning a transcription start site (TSS), e.g., upstream or downstream of a TSS, have a high level of orthogonality, start with a 5'G and PAM is NNGRRT. It is contemplated herein that in an embodiment the targeting domain hybridizes to the target domain through complementary base pairing. Any of the targeting domains in the table can be used with a S. aureus eiCas9 fusion molecule (e.g., an eiCas9 fused to a transcription activator or repressor domain) to alter (e.g., activate or repress) the BRCA1 gene. One or more gRNA may be used to target an eiCas9 fusion molecule to a region spanning 500 bp of a transcription start site (TSS) of the BRCA1 gene.

TABLE II.50A

Exemplary HDR-enhancing gRNAs Targeting a BRCA1 Gene

| S. aureus | A high level of orthogonality, starts with a G, PAM is NNGRRT 50A | | | |
|---|---|---|---|---|
| 1st Tier gRNA Name | DNA Strand | Targeting Domain | Target Site Length | Seq ID |
| BRCA1-39 | − | GAGCCAAGCGUCUCUCGGGGCU | 22 | 1581 |
| BRCA1-40 | − | GGAUUGGCCACCCAGUCUGCCC | 22 | 1582 |

Table II.50B provides exemplary targeting domains of gRNAs to be used with an eiCas9 fusion molecule (e.g., an eiCas9 fused to a transcription activator or repressor domain) to alter (e.g., activate or repress) a gene, e.g., BRCA1 gene. The targeting domains of gRNAs were selected according to the second tier parameters. The targeting domains bind within 500 bp spanning a transcription start site (TSS), e.g., upstream or downstream of a TSS, have a high level of orthogonality and PAM is NNGRRT. It is contemplated herein that in an embodiment the targeting domain hybridizes to the target domain through complementary base pairing. Any of the targeting domains in the table can be used with a S. aureus eiCas9 fusion molecule (e.g., an eiCas9 fused to a transcription activator or repressor domain) to alter (e.g., activate or repress) the BRCA1 gene. One or more gRNA may be used to target an eiCas9 fusion molecule to a region spanning 500 bp of a transcription start site (TSS) of the BRCA1 gene.

Table II.51A provides exemplary targeting domains of gRNAs to be used with an eiCas9 fusion molecule (e.g., an eiCas9 fused to a transcription activator or repressor domain) to alter (e.g., activate or repress) a gene, e.g., RBBP8 gene. The targeting domains of gRNAs were selected according to the first tier parameters. The targeting domains bind within 500 bp spanning a transcription start site (TSS), e.g., upstream or downstream of a TSS, have a high level of orthogonality and start with a 5'G. It is contemplated herein that in an embodiment the targeting domain hybridizes to the target domain through complementary base pairing. Any of the targeting domains in the table can be used with a S. pyogenes eiCas9 fusion molecule (e.g., an eiCas9 fused to a transcription activator or repressor domain) to alter (e.g., activate or repress) the RBBP8 gene. One or more gRNA may be used to target an eiCas9 fusion molecule to a region spanning 500 bp of a transcription start site (TSS) of the RBBP8 gene.

TABLE II.50B

Exemplary HDR-enhancing gRNAs Targeting a BRCA1 Gene

| S. aureus | A high level of orthogonality, and PAM is NNGRRT 50B | | | |
|---|---|---|---|---|
| 2nd Tier gRNA Name | DNA Strand | Targeting Domain | Target Site Length | Seq ID |
| BRCA1-41 | − | AAAAGGAAAGAGACGGAAGAGG | 22 | 1583 |
| BRCA1-42 | + | ACAGGGGCCCAAGUGAUGCUC | 22 | 1584 |
| BRCA1-43 | − | AUACGAAAUCAAGGUACAAUCA | 22 | 1585 |
| BRCA1-44 | + | AUGCUCUGGGGUACUGGCGUGG | 22 | 1586 |
| BRCA1-45 | + | CAGGAGGCCUUCACCCUCUGCU | 22 | 1587 |
| BRCA1-46 | + | CCUCUGCUCUGGGUAAAGGUAG | 22 | 1588 |
| BRCA1-47 | − | CUACCGCUAAGCAGCAGCCUCU | 22 | 1589 |
| BRCA1-48 | − | UCUACUACCUUUACCCAGAGCA | 22 | 1590 |
| BRCA1-49 | + | UCUGGGGUACUGGCGUGGGAGA | 22 | 1591 |
| BRCA1-50 | + | UUCCGUGGCAACGGAAAAGCGC | 22 | 1592 |
| BRCA1-51 | + | UUCCUGGACGGGGACAGGCUG | 22 | 1593 |
| BRCA1-52 | + | UUUUACGUCAUCCGGGGCAGA | 22 | 1594 |

TABLE II.51A

Exemplary HDR-enhancing gRNAs Targeting a RBBP8 Gene

S. pyogenes — A high level of orthogonality, and starts with a G — 51A

| 1st Tier gRNA Name | DNA Strand | Targeting Domain | Target Site Length | Seq ID |
|---|---|---|---|---|
| RBBP8-1 | + | GAAUCCCGAGGCAAUCUCGG | 20 | 1595 |
| RBBP8-2 | − | GACAGCCCGCGCUUUAAGGC | 20 | 1596 |
| RBBP8-3 | − | GAGCCCGCGCGACGUCACGC | 20 | 1597 |
| RBBP8-4 | − | GAGGAGCGGGCUCUUCGGUG | 20 | 1598 |
| RBBP8-5 | − | GAUUCGCGAAAGCCCCCGAA | 20 | 1599 |
| RBBP8-6 | + | GCCAGACCCGCACGCGGAAC | 20 | 1600 |
| RBBP8-7 | − | GCCCGCGCCGGUUCCGCGUG | 20 | 1601 |
| RBBP8-8 | + | GCCCGGGCUACACUCGGUGG | 20 | 1602 |
| RBBP8-9 | − | GCCGGUUCCGCGUGCGGGUC | 20 | 1603 |
| RBBP8-10 | + | GCCUUAAAGCGCGGGCUGUC | 20 | 1604 |
| RBBP8-11 | − | GCUUUAAGGCCGGGGCUGC | 20 | 1605 |
| RBBP8-12 | − | GGAGCCCGCGCGACGUCACG | 20 | 1606 |
| RBBP8-13 | − | GGAUUCGCGAAAGCCCCCGA | 20 | 1607 |
| RBBP8-14 | + | GGCGAAGGGCUCCCGGGGUA | 20 | 1608 |
| RBBP8-15 | + | GGCUCGCGCGCGCUUCGG | 20 | 1609 |
| RBBP8-16 | − | GGGGCGGGCUUGGCGGCGAA | 20 | 1610 |
| RBBP8-17 | + | GGGGGCUUUCGCGAAUCCCG | 20 | 1611 |
| RBBP8-18 | − | GGUAGCGCUCGUCCUCCCGC | 20 | 1612 |
| RBBP8-19 | − | GUCGCUCCGACCCAGAGCUC | 20 | 1613 |
| RBBP8-20 | + | GUGCUUGGCGAAGGGCUCCC | 20 | 1614 |

Table II.51B provides exemplary targeting domains of gRNAs to be used with an eiCas9 fusion molecule (e.g., an eiCas9 fused to a transcription activator or repressor domain) to alter (e.g., activate or repress) a gene, e.g., RBBP8 gene. The targeting domains of gRNAs were selected according to the second tier parameters. The targeting domains bind within 500 bp spanning a transcription start site (TSS), e.g., upstream or downstream of a TSS and have a high level of orthogonality. It is contemplated herein that in an embodiment the targeting domain hybridizes to the target domain through complementary base pairing. Any of the targeting domains in the table can be used with a S. pyogenes eiCas9 fusion molecule (e.g., an eiCas9 fused to a transcription activator or repressor domain) to alter (e.g., activate or repress) the RBBP8 gene. One or more gRNA may be used to target an eiCas9 fusion molecule to a region spanning 500 bp of a transcription start site (TSS) of the RBBP8 gene.

TABLE II.51B

Exemplary HDR-enhancing gRNAs Targeting a RBBP8 Gene

S. pyogenes — A high level of orthogonality — 51B

| 2nd Tier gRNA Name | DNA Strand | Targeting Domain | Target Site Length | Seq ID |
|---|---|---|---|---|
| RBBP8-21 | + | AACUCCCGCGUGACGUCGCG | 20 | 1615 |
| RBBP8-22 | + | ACCCGCACGCGGAACCGGCG | 20 | 1616 |
| RBBP8-23 | − | ACCGCCUCCGAGAUUGCCUC | 20 | 1617 |
| RBBP8-24 | + | ACGAAGUGCGCCGCCGCGAU | 20 | 1618 |

TABLE II.51B-continued

Exemplary HDR-enhancing gRNAs Targeting a RBBP8 Gene

*S. pyogenes* — A high level of orthogonality 51B

| 2nd Tier gRNA Name | DNA Strand | Targeting Domain | Target Site Length | Seq ID |
|---|---|---|---|---|
| RBBP8-25 | + | ACGUCGCGCGGGCUCCCGGG | 20 | 1619 |
| RBBP8-26 | + | ACUCCCGCGUGACGUCGCGC | 20 | 1620 |
| RBBP8-27 | – | AGCCCGCGCUUUAAGGCCGG | 20 | 1621 |
| RBBP8-28 | + | CAACCAUCGCCCUCCGGGAU | 20 | 1622 |
| RBBP8-29 | + | CACGAAGUGCGCCGCCGCGA | 20 | 1623 |
| RBBP8-30 | – | CAUCCCGGAGGGCGAUGGUU | 20 | 1624 |
| RBBP8-31 | – | CCCGCGCCGGUUCCGCGUGC | 20 | 1625 |
| RBBP8-32 | + | CGCGAAUCCCGAGGCAAUCU | 20 | 1626 |
| RBBP8-33 | + | CGCGCGCUUCGGAGGUUUUU | 20 | 1627 |
| RBBP8-34 | + | CGGGCCCGGGCUACACUCGG | 20 | 1628 |
| RBBP8-35 | + | CGUGACGUCGCGCGGGCUCC | 20 | 1629 |
| RBBP8-36 | + | UAAAGCGCGGGCUGUCCGGA | 20 | 1630 |
| RBBP8-37 | + | UCCCGAGGCAAUCUCGGAGG | 20 | 1631 |
| RBBP8-38 | – | UCCGGACAGCCCGCGCUUUA | 20 | 1632 |
| RBBP8-39 | – | UCGGUGCGGCCCAUCCCGGA | 20 | 1633 |
| RBBP8-40 | + | UUAAAGCGCGGGCUGUCCGG | 20 | 1634 |

Table II.52A provides exemplary targeting domains of gRNAs to be used with an eiCas9 fusion molecule (e.g., an eiCas9 fused to a transcription activator or repressor domain) to alter (e.g., activate or repress) a gene, e.g., RBBP8 gene. The targeting domains of gRNAs were selected according to the first tier parameters. The targeting domains bind within 500 bp spanning a transcription start site (TSS), e.g., upstream or downstream of a TSS, have a high level of orthogonality, start with a 5'G and PAM is NNGRRT. It is contemplated herein that in an embodiment the targeting domain hybridizes to the target domain through complementary base pairing. Any of the targeting domains in the table can be used with a S. *aureus* eiCas9 fusion molecule (e.g., an eiCas9 fused to a transcription activator or repressor domain) to alter (e.g., activate or repress) the RBBP8 gene. One or more gRNA may be used to target an eiCas9 fusion molecule to a region spanning 500 bp of a transcription start site (TSS) of the RBBP8 gene.

TABLE II.52A

Exemplary HDR-enhancing gRNAs Targeting a RBBP8 Gene

*S. aureus* — A high level of orthogonality, starts with a G, PAM is NNGRRT 52A

| 1st Tier gRNA Name | DNA Strand | Targeting Domain | Target Site Length | Seq ID |
|---|---|---|---|---|
| RBBP8-41 | + | GAGCGCUACCUCAGUACUACUU | 22 | 1635 |
| RBBP8-42 | – | GCAGUCGCUCCGACCCAGAGCU | 22 | 1636 |
| RBBP8-43 | – | GGGAGCCCGCGCGACGUCACGC | 22 | 1637 |
| RBBP8-44 | + | GGGUAGGGGUGGCUCCCGGCUC | 22 | 1638 |
| RBBP8-45 | – | GGUGCCCGCGCCGGUUCCGCGU | 22 | 1639 |
| RBBP8-46 | + | GUCGCGCGGGCUCCCGGGCGGG | 22 | 1640 |

Table II.52B provides exemplary targeting domains of gRNAs to be used with an eiCas9 fusion molecule (e.g., an eiCas9 fused to a transcription activator or repressor domain) to alter (e.g., activate or repress) a gene, e.g., RBBP8 gene. The targeting domains of gRNAs were selected according to the second tier parameters. The targeting domains bind within 500 bp spanning a transcription start site (TSS), e.g., upstream or downstream of a TSS, have a high level of orthogonality and PAM is NNGRRT. It is contemplated herein that in an embodiment the targeting domain hybridizes to the target domain through complementary base pairing. Any of the targeting domains in the table can be used with a *S. aureus* eiCas9 fusion molecule (e.g., an eiCas9 fused to a transcription activator or repressor domain) to alter (e.g., activate or repress) the RBBP8 gene. One or more gRNA may be used to target an eiCas9 fusion molecule to a region spanning 500 bp of a transcription start site (TSS) of the RBBP8 gene.

TABLE II.52B

Exemplary HDR-enhancing gRNAs Targeting a RBBP8 Gene

*S. aureus* — A high level of orthogonality, and PAM is NNGRRT — 52B

| 2nd Tier gRNA Name | DNA Strand | Targeting Domain | Target Site Length | Seq ID |
|---|---|---|---|---|
| RBBP8-47 | + | CCUUAAAGCGCGGGCUGUCCGG | 22 | 1641 |
| RBBP8-48 | − | CGCUCCGACCCAGAGCUCCGGG | 22 | 1642 |
| RBBP8-49 | + | CGGAGGGGUCGGCUUUCCCACC | 22 | 1643 |
| RBBP8-50 | + | CGGCGCGGGCACCUGGGGAGAA | 22 | 1644 |
| RBBP8-51 | − | CUCACCGCCUCCGAGAUUGCCU | 22 | 1645 |
| RBBP8-52 | − | CUCUUUCGCCCUUUUCCCUCAC | 22 | 1646 |
| RBBP8-53 | + | CUUGGCGAAGGGCUCCCGGGGU | 22 | 1647 |
| RBBP8-54 | + | UCCCGAGGCAAUCUCGGAGGCG | 22 | 1648 |
| RBBP8-55 | − | UCCUCCCGCCGGUCCACCACCA | 22 | 1649 |
| RBBP8-56 | + | UCGCUUCCCUUCGGGGCUUUC | 22 | 1650 |
| RBBP8-57 | + | UCUCUUUACCCCACCCGGAGCU | 22 | 1651 |
| RBBP8-58 | + | UGCGUGCUUGGCGAAGGGCUCC | 22 | 1652 |

Table II.53A provides exemplary targeting domains of gRNAs to be used with an eiCas9 fusion molecule (e.g., an eiCas9 fused to a transcription activator or repressor domain) to alter (e.g., activate or repress) a gene, e.g., EXO1 gene. The targeting domains of gRNAs were selected according to the first tier parameters. The targeting domains bind within 500 bp spanning a transcription start site (TSS), e.g., upstream or downstream of a TSS, have a high level of orthogonality and start with a 5'G. It is contemplated herein that in an embodiment the targeting domain hybridizes to the target domain through complementary base pairing. Any of the targeting domains in the table can be used with a *S. pyogenes* eiCas9 fusion molecule (e.g., an eiCas9 fused to a transcription activator or repressor domain) to alter (e.g., activate or repress) the EXO1 gene. One or more gRNA may be used to target an eiCas9 fusion molecule to a region spanning 500 bp of a transcription start site (TSS) of the EXO1 gene.

TABLE II.53A

Exemplary HDR-enhancing gRNAs Targeting an EXO1 Gene

*S. pyogenes* — A high level of orthogonality, and starts with a G — 53A

| 1st Tier gRNA Name | DNA Strand | Targeting Domain | Target Site Length | Seq ID |
|---|---|---|---|---|
| EXO1-1 | − | GACGCGCAGGUCGACCCCCA | 20 | 1653 |
| EXO1-2 | + | GACGUCACAUCCUCUGGGCG | 20 | 1654 |

TABLE II.53A-continued

Exemplary HDR-enhancing gRNAs Targeting an EXO1 Gene

| S. pyogenes | A high level of orthogonality, and starts with a G 53A | | | |
|---|---|---|---|---|
| 1st Tier gRNA Name | DNA Strand | Targeting Domain | Target Site Length | Seq ID |
| EXO1-3 | + | GAGAGCAGACGAUUCCGGGC | 20 | 1655 |
| EXO1-4 | + | GAGGAGAGUCCCUUCUCGGA | 20 | 1656 |
| EXO1-5 | − | GAGGGUCGGAGGUGACGCGC | 20 | 1657 |
| EXO1-6 | + | GAUAAGAGAGCAGACGAUUC | 20 | 1658 |
| EXO1-7 | + | GCACAUCUCCGCGAGACAGA | 20 | 1659 |
| EXO1-8 | + | GCCUAAGGAAACGUGUCGUC | 20 | 1660 |
| EXO1-9 | − | GCGGAAAAAUGAGGUAAGUC | 20 | 1661 |
| EXO1-10 | + | GCGGGCUGUGCGGAGGCUAA | 20 | 1662 |
| EXO1-11 | + | GCGUUGACGUCACAUCCUCU | 20 | 1663 |
| EXO1-12 | + | GCUAAUGGGUGGGUUCCCUU | 20 | 1664 |
| EXO1-13 | − | GCUGACCUUUCAAUUUGCGC | 20 | 1665 |
| EXO1-14 | + | GGAAACGUGUCGUCUGGAAU | 20 | 1666 |
| EXO1-15 | + | GGCUAAUGGGUGGGUUCCCU | 20 | 1667 |
| EXO1-16 | − | GGCUGACCUUUCAAUUUGCG | 20 | 1668 |
| EXO1-17 | + | GGGAUUCGGGUCUUCCAGGA | 20 | 1669 |
| EXO1-18 | + | GUGAGUUAGGGGCGUCGGAG | 20 | 1670 |
| EXO1-19 | + | GUGUUCUGCGUUGCCGGCCG | 20 | 1671 |
| EXO1-20 | + | GUUGCCGGCCGUGGGUGCUC | 20 | 1672 |

Table II.53B provides exemplary targeting domains of gRNAs to be used with an eiCas9 fusion molecule (e.g., an eiCas9 fused to a transcription activator or repressor domain) to alter (e.g., activate or repress) a gene, e.g., EXO1 gene. The targeting domains of gRNAs were selected according to the second tier parameters. The targeting domains bind within 500 bp spanning a transcription start site (TSS), e.g., upstream or downstream of a TSS and have a high level of orthogonality. It is contemplated herein that in an embodiment the targeting domain hybridizes to the target domain through complementary base pairing. Any of the targeting domains in the table can be used with a S. pyogenes eiCas9 fusion molecule (e.g., an eiCas9 fused to a transcription activator or repressor domain) to alter (e.g., activate or repress) the EXO1 gene. One or more gRNA may be used to target an eiCas9 fusion molecule to a region spanning 500 bp of a transcription start site (TSS) of the EXO1 gene.

TABLE II.53B

Exemplary HDR-enhancing gRNAs Targeting an EXO1 Gene

| S. pyogenes | A high level of orthogonality 53B | | | |
|---|---|---|---|---|
| 2nd Tier gRNA Name | DNA Strand | Targeting Domain | Target Site Length | Seq ID |
| EXO1-21 | + | AAUCGGCUCCGCUCAAGGGG | 20 | 1673 |
| EXO1-22 | + | ACCGCAAUCGGCUCCGCUCA | 20 | 1674 |
| EXO1-23 | − | ACGCGCAGGUCGACCCCCAA | 20 | 1675 |
| EXO1-24 | − | ACGGCCGGCAACGCAGAACA | 20 | 1676 |
| EXO1-25 | + | AGGAACCCGCGCAAAUUGAA | 20 | 1677 |
| EXO1-26 | + | CAGCCUUUCGCGCGCUGUGU | 20 | 1678 |

TABLE II.53B-continued

Exemplary HDR-enhancing gRNAs Targeting an EXO1 Gene

S. pyogenes — A high level of orthogonality 53B

| 2nd Tier gRNA Name | DNA Strand | Targeting Domain | Target Site Length | Seq ID |
|---|---|---|---|---|
| EXO1-27 | + | CCGACCCUCCUCUCGGGAUU | 20 | 1679 |
| EXO1-28 | + | CCGCAAUCGGCUCCGCUCAA | 20 | 1680 |
| EXO1-29 | + | CGCAAUCGGCUCCGCUCAAG | 20 | 1681 |
| EXO1-30 | + | CGCGUUGACGUCACAUCCUC | 20 | 1682 |
| EXO1-31 | − | CGGCCGGCAACGCAGAACAC | 20 | 1683 |
| EXO1-32 | + | CGGGUUUCUCCAACCGCAAU | 20 | 1684 |
| EXO1-33 | − | CUCGCGGAGAUGUGCAGGCG | 20 | 1685 |
| EXO1-34 | − | UCAACGCGUAUCCCGCAACC | 20 | 1686 |
| EXO1-35 | + | UCUCGGGAUUCGGGUCUUCC | 20 | 1687 |
| EXO1-36 | − | UGAGCGGAGCCGAUUGCGGU | 20 | 1688 |
| EXO1-37 | − | UGGAAGACCCGAAUCCCGAG | 20 | 1689 |
| EXO1-38 | + | UGUUCUGCGUUGCCGGCCGU | 20 | 1690 |
| EXO1-39 | + | UUACCCGUGUUCUGCGUUGC | 20 | 1691 |
| EXO1-40 | − | UUGCCUACACAGCGCGCGAA | 20 | 1692 |

Table II.54A provides exemplary targeting domains of gRNAs to be used with an eiCas9 fusion molecule (e.g., an eiCas9 fused to a transcription activator or repressor domain) to alter (e.g., activate or repress) a gene, e.g., EXO1 gene. The targeting domains of gRNAs were selected according to the first tier parameters. The targeting domains bind within 500 bp spanning a transcription start site (TSS), e.g., upstream or downstream of a TSS, have a high level of orthogonality, start with a 5'G and PAM is NNGRRT. It is contemplated herein that in an embodiment the targeting domain hybridizes to the target domain through complementary base pairing. Any of the targeting domains in the table can be used with a S. aureus eiCas9 fusion molecule (e.g., an eiCas9 fused to a transcription activator or repressor domain) to alter (e.g., activate or repress) the EXO1 gene. One or more gRNA may be used to target an eiCas9 fusion molecule to a region spanning 500 bp of a transcription start site (TSS) of the EXO1 gene.

TABLE II.54A

Exemplary HDR-enhancing gRNAs Targeting an EXO1 Gene

S. aureus — A high level of orthogonality, starts with a G, PAM is NNGRRT 54A

| 1st Tier gRNA Name | DNA Strand | Targeting Domain | Target Site Length | Seq ID |
|---|---|---|---|---|
| EXO1-41 | + | GAUUCCGGGCUGGAGCAGGCGC | 22 | 1693 |
| EXO1-42 | − | GCCUCCUGCGGCUUCCAACUCA | 22 | 1694 |
| EXO1-43 | + | GCGUCACCUCCGACCCUCCUCU | 22 | 1695 |
| EXO1-44 | + | GGAGAGCUCAGGACGCAACCCU | 22 | 1696 |
| EXO1-45 | + | GGAGCGGGCUGUGCGGAGGCUA | 22 | 1697 |
| EXO1-46 | + | GGCCGUGGGUGCUCUGGCCACA | 22 | 1698 |
| EXO1-47 | + | GGGUCUUCCAGGAAGGGAAGGA | 22 | 1699 |
| EXO1-48 | − | GGGUUCCUUGCGGCCCCGCCCA | 22 | 1700 |

Table II.54B provides exemplary targeting domains of gRNAs to be used with an eiCas9 fusion molecule (e.g., an eiCas9 fused to a transcription activator or repressor domain) to alter (e.g., activate or repress) a gene, e.g., EXO1 gene. The targeting domains of gRNAs were selected according to the second tier parameters. The targeting domains bind within 500 bp spanning a transcription start site (TSS), e.g., upstream or downstream of a TSS, have a high level of orthogonality and PAM is NNGRRT. It is contemplated herein that in an embodiment the targeting domain hybridizes to the target domain through complementary base pairing. Any of the targeting domains in the table can be used with a S. aureus eiCas9 fusion molecule (e.g., an eiCas9 fused to a transcription activator or repressor domain) to alter (e.g., activate or repress) the EXO1 gene. One or more gRNA may be used to target an eiCas9 fusion molecule to a region spanning 500 bp of a transcription start site (TSS) of the EXO1 gene.

Table II.55A provides exemplary targeting domains of gRNAs to be used with an eiCas9 fusion molecule (e.g., an eiCas9 fused to a transcription activator or repressor domain) to alter (e.g., activate or repress) a gene, e.g., DNA2 gene. The targeting domains of gRNAs were selected according to the first tier parameters. The targeting domains bind within 500 bp spanning a transcription start site (TSS), e.g., upstream or downstream of a TSS, have a high level of orthogonality and start with a 5'G. It is contemplated herein that in an embodiment the targeting domain hybridizes to the target domain through complementary base pairing. Any of the targeting domains in the table can be used with a S. pyogenes eiCas9 fusion molecule (e.g., an eiCas9 fused to a transcription activator or repressor domain) to alter (e.g., activate or repress) the DNA2 gene. One or more gRNA may be used to target an eiCas9 fusion molecule to a region spanning 500 bp of a transcription start site (TSS) of the DNA2 gene.

TABLE II.54B

Exemplary HDR-enhancing gRNAs Targeting an EXO1 Gene

S. aureus — A high level of orthogonality, and PAM is NNGRRT 54B

| 2nd Tier gRNA Name | DNA Strand | Targeting Domain | Target Site Length | Seq ID |
|---|---|---|---|---|
| EXO1-49 | − | AAAGGCUGACCUUUCAAUUUGC | 22 | 1701 |
| EXO1-50 | − | AACCCUGGCGCCUGCUCCAGCC | 22 | 1702 |
| EXO1-51 | + | ACAGCGGAGCCCUUAGCCUGAG | 22 | 1703 |
| EXO1-52 | + | ACAGUGAGUUAGGGGCGUCGGA | 22 | 1704 |
| EXO1-53 | + | ACCCAACAGCGGAGCCCUUAGC | 22 | 1705 |
| EXO1-54 | − | ACUCAGGCUAAGGGCUCCGCUG | 22 | 1706 |
| EXO1-55 | + | AGGCCUAAGGAAACGUGUCGUC | 22 | 1707 |
| EXO1-56 | + | AGGCUAAUGGGUGGGUUCCCUU | 22 | 1708 |
| EXO1-57 | − | CCCACGGCCGGCAACGCAGAAC | 22 | 1709 |
| EXO1-58 | + | CCCGUGUUCUGCGUUGCCGGCC | 22 | 1710 |
| EXO1-59 | + | CCUCCGACCCUCCUCUCGGGAU | 22 | 1711 |
| EXO1-60 | + | CCUGCACAUCUCCGCGAGACAG | 22 | 1712 |
| EXO1-61 | + | CGCAGGAGGCGGAACCGGGUUG | 22 | 1713 |
| EXO1-62 | + | CGGCUCCGCUCAAGGGGAGGAG | 22 | 1714 |
| EXO1-63 | + | CGGGCUGUGCGGAGGCUAAUGG | 22 | 1715 |
| EXO1-64 | − | UCUCCUUCCCUUCCUGGAAGAC | 22 | 1716 |
| EXO1-65 | − | UGGAAGACCCGAAUCCCGAGAG | 22 | 1717 |
| EXO1-66 | + | UUGGAAGCCGCAGGAGGCGGAA | 22 | 1718 |

TABLE II.55A

Exemplary HDR-enhancing gRNAs Targeting a DNA2 Gene

| S. pyogenes | A high level of orthogonality, and starts with a G 55A | | | |
|---|---|---|---|---|
| 1st Tier gRNA Name | DNA Strand | Targeting Domain | Target Site Length | Seq ID |
| DNA2-1 | + | GAACGAACUGGAGCUGCUGA | 20 | 1719 |
| DNA2-2 | + | GAAGAGUUUUUGGGAGGAGG | 20 | 1720 |
| DNA2-3 | − | GACAGAAAAGACAGCGGAAC | 20 | 1721 |
| DNA2-4 | + | GAGCCCUGCUGCUCAGGUGA | 20 | 1722 |
| DNA2-5 | + | GAUGGAGAAGAGUUUUUGGG | 20 | 1723 |
| DNA2-6 | + | GAUGGAGCAGCUGAACGAAC | 20 | 1724 |
| DNA2-7 | − | GCGCCGGCGCGUUCCACGUG | 20 | 1725 |
| DNA2-8 | + | GCGGCCUGGCGCAGGUCAUU | 20 | 1726 |
| DNA2-9 | + | GCUGAUGGAGAAGAGUUUUU | 20 | 1727 |
| DNA2-10 | + | GCUGCCGGCGGAGCUGUGAG | 20 | 1728 |
| DNA2-11 | − | GCUGCUCCAUCCUGGACGCG | 20 | 1729 |
| DNA2-12 | + | GGAACGCGCCGGCGCGGGAG | 20 | 1730 |
| DNA2-13 | + | GGAGAAGAGUUUUUGGGAGG | 20 | 1731 |
| DNA2-14 | + | GGGACAGAGCCCUGCUGCUC | 20 | 1732 |
| DNA2-15 | + | GGGAGGUUUCGGACACGGGU | 20 | 1733 |
| DNA2-16 | + | GGGCCCCACGUGGAACGCGC | 20 | 1734 |
| DNA2-17 | − | GGGCCCCUCACCUGAGCAGC | 20 | 1735 |
| DNA2-18 | + | GGUUGGAGUGUCAAGAGAGA | 20 | 1736 |
| DNA2-19 | + | GUAUUCCCAGUCCUAAGCAA | 20 | 1737 |
| DNA2-20 | + | GUGGAACGCGCCGGCGCGGG | 20 | 1738 |

Table II.55B provides exemplary targeting domains of gRNAs to be used with an eiCas9 fusion molecule (e.g., an eiCas9 fused to a transcription activator or repressor domain) to alter (e.g., activate or repress) a gene, e.g., DNA2 gene. The targeting domains of gRNAs were selected according to the second tier parameters. The targeting domains bind within 500 bp spanning a transcription start site (TSS), e.g., upstream or downstream of a TSS and have a high level of orthogonality. It is contemplated herein that in an embodiment the targeting domain hybridizes to the target domain through complementary base pairing. Any of the targeting domains in the table can be used with a S. pyogenes eiCas9 fusion molecule (e.g., an eiCas9 fused to a transcription activator or repressor domain) to alter (e.g., activate or repress) the DNA2 gene. One or more gRNA may be used to target an eiCas9 fusion molecule to a region spanning 500 bp of a transcription start site (TSS) of the DNA2 gene.

TABLE II.55B

Exemplary HDR-enhancing gRNAs Targeting a DNA2 Gene

S. pyogenes — A high level of orthogonality 55B

| 2nd Tier gRNA Name | DNA Strand | Targeting Domain | Target Site Length | Seq ID |
|---|---|---|---|---|
| DNA2-21 | + | AACCCGGGAGGUUUCGGACA | 20 | 1739 |
| DNA2-22 | - | AACCCGUGUCCGAAACCUCC | 20 | 1740 |
| DNA2-23 | - | ACAGAAAAGACAGCGGAACC | 20 | 1741 |
| DNA2-24 | + | ACCCGGGAGGUUUCGGACAC | 20 | 1742 |
| DNA2-25 | - | ACCCGUGUCCGAAACCUCCC | 20 | 1743 |
| DNA2-26 | - | AGAAAAGACAGCGGAACCGG | 20 | 1744 |
| DNA2-27 | + | AGUCCUAAGCAAGGGAGCAA | 20 | 1745 |
| DNA2-28 | + | AGUUUGCGAUCCCCGCGUCC | 20 | 1746 |
| DNA2-29 | + | CACGUGGAACGCGCCGGCGC | 20 | 1747 |
| DNA2-30 | - | CAGAAAAGACAGCGGAACCG | 20 | 1748 |
| DNA2-31 | + | CCACGUGGAACGCGCCGGCG | 20 | 1749 |
| DNA2-32 | - | CCGCGCCGGCGCGUUCCACG | 20 | 1750 |
| DNA2-33 | + | CGCAUGCGCGCGAGGUGCGC | 20 | 1751 |
| DNA2-34 | - | CGCGCCGGCGCGUUCCACGU | 20 | 1752 |
| DNA2-35 | + | CGGCCUGGCGCAGGUCAUUU | 20 | 1753 |
| DNA2-36 | + | UGCGAUCCCCGCGUCCAGGA | 20 | 1754 |
| DNA2-37 | + | UGGAACGCGCCGGCGCGGGA | 20 | 1755 |
| DNA2-38 | - | UGUCCCAAAUGACCUGCGCC | 20 | 1756 |
| DNA2-39 | - | UUCGUUCAGCUGCUCCAUCC | 20 | 1757 |
| DNA2-40 | - | UUGCUCCCUUGCUUAGGACU | 20 | 1758 |

Table II.56A provides exemplary targeting domains of gRNAs to be used with an eiCas9 fusion molecule (e.g., an eiCas9 fused to a transcription activator or repressor domain) to alter (e.g., activate or repress) a gene, e.g., DNA2 gene. The targeting domains of gRNAs were selected according to the first tier parameters. The targeting domains bind within 500 bp spanning a transcription start site (TSS), e.g., upstream or downstream of a TSS, have a high level of orthogonality, start with a 5'G and PAM is NNGRRT. It is contemplated herein that in an embodiment the targeting domain hybridizes to the target domain through complementary base pairing. Any of the targeting domains in the table can be used with a S. aureus eiCas9 fusion molecule (e.g., an eiCas9 fused to a transcription activator or repressor domain) to alter (e.g., activate or repress) the DNA2 gene. One or more gRNA may be used to target an eiCas9 fusion molecule to a region spanning 500 bp of a transcription start site (TSS) of the DNA2 gene.

TABLE II.56A

Exemplary HDR-enhancing gRNAs Targeting a DNA2 Gene

S. aureus — A high level of orthogonality, starts with a G, PAM is NNGRRT 56A

| 1st Tier gRNA Name | DNA Strand | Targeting Domain | Target Site Length | Seq ID |
|---|---|---|---|---|
| DNA2-41 | + | GCGCAGGUCAUUUGGGACAUCU | 22 | 1759 |
| DNA2-42 | + | GUGAACCCGGGAGGUUUCGGAC | 22 | 1760 |

Table II.56B provides exemplary targeting domains of gRNAs to be used with an eiCas9 fusion molecule (e.g., an eiCas9 fused to a transcription activator or repressor domain) to alter (e.g., activate or repress) a gene, e.g., DNA2 gene. The targeting domains of gRNAs were selected according to the second tier parameters. The targeting domains bind within 500 bp spanning a transcription start site (TSS), e.g., upstream or downstream of a TSS, have a high level of orthogonality and PAM is NNGRRT. It is contemplated herein that in an embodiment the targeting domain hybridizes to the target domain through complementary base pairing. Any of the targeting domains in the table can be used with a S. aureus eiCas9 fusion molecule (e.g., an eiCas9 fused to a transcription activator or repressor domain) to alter (e.g., activate or repress) the DNA2 gene. One or more gRNA may be used to target an eiCas9 fusion molecule to a region spanning 500 bp of a transcription start site (TSS) of the DNA2 gene.

TABLE II.56B

Exemplary HDR-enhancing gRNAs Targeting a DNA2 Gene

S. aureus — A high level of orthogonality, and PAM is NNGRRT 56B

| 2nd Tier gRNA Name | DNA Strand | Targeting Domain | Target Site Length | Seq ID |
|---|---|---|---|---|
| DNA2-43 | − | AGACAGAAAAGACAGCGGAACC | 22 | 1761 |
| DNA2-44 | + | CCGGGAGGUUUCGGACACGGGU | 22 | 1762 |
| DNA2-45 | + | CGAACUGGAGCUGCUGAUGGAG | 22 | 1763 |
| DNA2-46 | − | CUUGCUUAGGACUGGGAAUACA | 22 | 1764 |
| DNA2-47 | − | CUUUGCUCCCUUGCUUAGGACU | 22 | 1765 |
| DNA2-48 | + | UACAGUUUGCGAUCCCCGCGUC | 22 | 1766 |
| DNA2-49 | − | UCAGCUGCUCCAUCCUGGACGC | 22 | 1767 |
| DNA2-50 | − | UCCAACCCGUGUCCGAAACCUC | 22 | 1768 |

Table II.57A provides exemplary targeting domains of gRNAs to be used with an eiCas9 fusion molecule (e.g., an eiCas9 fused to a transcription activator or repressor domain) to alter (e.g., activate or repress) a gene, e.g., MRE11A gene. The targeting domains of gRNAs were selected according to the first tier parameters. The targeting domains bind within 500 bp spanning a transcription start site (TSS), e.g., upstream or downstream of a TSS, have a high level of orthogonality and start with a 5'G. It is contemplated herein that in an embodiment the targeting domain hybridizes to the target domain through complementary base pairing. Any of the targeting domains in the table can be used with a S. pyogenes eiCas9 fusion molecule (e.g., an eiCas9 fused to a transcription activator or repressor domain) to alter (e.g., activate or repress) the MRE11A gene. One or more gRNA may be used to target an eiCas9 fusion molecule to a region spanning 500 bp of a transcription start site (TSS) of the MRE11A gene.

TABLE II.57A

Exemplary HDR-enhancing gRNAs Targeting a MRE11A Gene

S. pyogenes — A high level of orthogonality, and starts with a G 57A

| 1st Tier gRNA Name | DNA Strand | Targeting Domain | Target Site Length | Seq ID |
|---|---|---|---|---|
| MRE11A-1 | − | GAACCCGGAAGUGAGAUGCA | 20 | 1769 |
| MRE11A-2 | − | GAGCCAAUCCUGAGCAGGCU | 20 | 1770 |
| MRE11A-3 | + | GAUUGGCUCCUGCGUGAGGG | 20 | 1771 |
| MRE11A-4 | + | GCCGCCUUGCAUCUCACUUC | 20 | 1772 |
| MRE11A-5 | − | GCCGUAAACCUGAAUUCCGC | 20 | 1773 |
| MRE11A-6 | − | GCGAGGCCCCGCCCUCACGC | 20 | 1774 |

TABLE II.57A-continued

Exemplary HDR-enhancing gRNAs Targeting a MRE11A Gene

S. pyogenes — A high level of orthogonality, and starts with a G
57A

| 1st Tier gRNA Name | DNA Strand | Targeting Domain | Target Site Length | Seq ID |
|---|---|---|---|---|
| MRE11A-7 | − | GGCCGUAAACCUGAAUUCCG | 20 | 1775 |
| MRE11A-8 | − | GGCUACCGCACGCAGUGAGG | 20 | 1776 |
| MRE11A-9 | − | GGGCGGGGAAAGUAGCGGCG | 20 | 1777 |
| MRE11A-10 | + | GUAGCCAAUGAGAGCCGAAC | 20 | 1778 |
| MRE11A-11 | + | GUUCGUCUCCUAGCCUGCUC | 20 | 1779 |
| MRE11A-12 | − | GUUUCUCUCGCGACACUUCA | 20 | 1780 |

Table II.57B provides exemplary targeting domains of gRNAs to be used with an eiCas9 fusion molecule (e.g., an eiCas9 fused to a transcription activator or repressor domain) to alter (e.g., activate or repress) a gene, e.g., MRE11A gene. The targeting domains of gRNAs were selected according to the second tier parameters. The targeting domains bind within 500 bp spanning a transcription start site (TSS), e.g., upstream or downstream of a TSS and have a high level of orthogonality. It is contemplated herein that in an embodiment the targeting domain hybridizes to the target domain through complementary base pairing. Any of the targeting domains in the table can be used with a S. pyogenes eiCas9 fusion molecule (e.g., an eiCas9 fused to a transcription activator or repressor domain) to alter (e.g., activate or repress) the MRE11A gene. One or more gRNA may be used to target an eiCas9 fusion molecule to a region spanning 500 bp of a transcription start site (TSS) of the MRE11A gene.

TABLE II.57B

Exemplary HDR-enhancing gRNAs Targeting a MRE11A Gene

S. pyogenes — A high level of orthogonality
57B

| 2nd Tier gRNA Name | DNA Strand | Targeting Domain | Target Site Length | Seq ID |
|---|---|---|---|---|
| MRE11A-13 | − | AAGUCCAGUUCGGCUCUCAU | 20 | 1781 |
| MRE11A-14 | − | ACCGCACGCAGUGAGGGGGC | 20 | 1782 |
| MRE11A-15 | + | ACGGACGCCGUUCUCUCCCG | 20 | 1783 |
| MRE11A-16 | − | AUUGGCUACCGCACGCAGUG | 20 | 1784 |
| MRE11A-17 | + | AUUGGCUCCUGCGUGAGGGC | 20 | 1785 |
| MRE11A-18 | + | CAGGAUUGGCUCCUGCGUGA | 20 | 1786 |
| MRE11A-19 | + | CCCCGCCCCCUCACUGCGUG | 20 | 1787 |
| MRE11A-20 | − | CCGCACGCAGUGAGGGGCG | 20 | 1788 |
| MRE11A-21 | + | CCGCCUUGCAUCUCACUUCC | 20 | 1789 |
| MRE11A-22 | − | CGCAGGAGCCAAUCCUGAGC | 20 | 1790 |
| MRE11A-23 | + | CGUUCUCUCCCGCGGAAUUC | 20 | 1791 |
| MRE11A-24 | − | CUGAAUUCCGCGGGAGAGAA | 20 | 1792 |
| MRE11A-25 | − | UACCGCACGCAGUGAGGGGG | 20 | 1793 |
| MRE11A-26 | − | UAGAUGCUUCAAGUCCAGUU | 20 | 1794 |
| MRE11A-27 | + | UCAGGAUUGGCUCCUGCGUG | 20 | 1795 |
| MRE11A-28 | + | UCCCGCGGAAUUCAGGUUUA | 20 | 1796 |
| MRE11A-29 | + | UCUCCUAGCCUGCUCAGGAU | 20 | 1797 |
| MRE11A-30 | − | UGGCUACCGCACGCAGUGAG | 20 | 1798 |

TABLE II.57B-continued

Exemplary HDR-enhancing gRNAs Targeting a MRE11A Gene

| S. pyogenes | | A high level of orthogonality 57B | | |
|---|---|---|---|---|
| 2nd Tier gRNA Name | DNA Strand | Targeting Domain | Target Site Length | Seq ID |
| MRE11A-31 | − | UUGGCUACCGCACGCAGUGA | 20 | 1799 |
| MRE11A-32 | + | UUGGCUCCUGCGUGAGGGCG | 20 | 1800 |

Table II.58A provides exemplary targeting domains of gRNAs to be used with an eiCas9 fusion molecule (e.g., an eiCas9 fused to a transcription activator or repressor domain) to alter (e.g., activate or repress) a gene, e.g., MRE11A gene. The targeting domains of gRNAs were selected according to the first tier parameters. The targeting domains bind within 500 bp spanning a transcription start site (TSS), e.g., upstream or downstream of a TSS, have a high level of orthogonality, start with a 5'G and PAM is NNGRRT. It is contemplated herein that in an embodiment the targeting domain hybridizes to the target domain through complementary base pairing. Any of the targeting domains in the table can be used with a S. aureus eiCas9 fusion molecule (e.g., an eiCas9 fused to a transcription activator or repressor domain) to alter (e.g., activate or repress) the MRE11A gene. One or more gRNA may be used to target an eiCas9 fusion molecule to a region spanning 500 bp of a transcription start site (TSS) of the MRE11A gene.

TABLE II.58A

Exemplary HDR-enhancing gRNA Targeting a MRE11A Gene

| S. aureus | | A high level of orthogonality, starts with a G, PAM is NNGRRT 58A | | |
|---|---|---|---|---|
| 1st Tier gRNA Name | DNA Strand | Targeting Domain | Target Site Length | Seq ID |
| MRE11A-33 | − | GAGAACCCGCAGGGCCGUAAAC | 22 | 1801 |

Table II.58B provides exemplary targeting domains of gRNAs to be used with an eiCas9 fusion molecule (e.g., an eiCas9 fused to a transcription activator or repressor domain) to alter (e.g., activate or repress) a gene, e.g., MRE11A gene. The targeting domains of gRNAs were selected according to the second tier parameters. The targeting domains bind within 500 bp spanning a transcription start site (TSS), e.g., upstream or downstream of a TSS, have a high level of orthogonality and PAM is NNGRRT. It is contemplated herein that in an embodiment the targeting domain hybridizes to the target domain through complementary base pairing. Any of the targeting domains in the table can be used with a S. aureus eiCas9 fusion molecule (e.g., an eiCas9 fused to a transcription activator or repressor domain) to alter (e.g., activate or repress) the MRE11A gene. One or more gRNA may be used to target an eiCas9 fusion molecule to a region spanning 500 bp of a transcription start site (TSS) of the MRE11A gene.

TABLE II.58B

Exemplary HDR-enhancing gRNAs Targeting a MRE11A Gene

| S. aureus | | A high level of orthogonality, and PAM is NNGRRT 58B | | |
|---|---|---|---|---|
| 2nd Tier gRNA Name | DNA Strand | Targeting Domain | Target Site Length | Seq ID |
| MRE11A-34 | + | AAACGGACGCCGUUCUCUCCCG | 22 | 1802 |
| MRE11A-35 | + | AUCGCCGCCUUGCAUCUCACUU | 22 | 1803 |
| MRE11A-36 | + | CAGACCGUGUUGUUUUCUUUUC | 22 | 1804 |
| MRE11A-37 | + | CGGAAUUCAGGUUUACGGCCCU | 22 | 1805 |

TABLE II.58B-continued

Exemplary HDR-enhancing gRNAs Targeting a MRE11A Gene

| S. aureus | A high level of orthogonality, and PAM is NNGRRT 58B | | | |
|---|---|---|---|---|
| 2nd Tier gRNA Name | DNA Strand | Targeting Domain | Target Site Length | Seq ID |
| MRE11A-38 | + | CGGGUUCGUCUCCUAGCCUGCU | 22 | 1806 |
| MRE11A-39 | − | UCCGUUUCUCUCGCGACACUUC | 22 | 1807 |

Table II.59A provides exemplary targeting domains of gRNAs to be used with an eiCas9 fusion molecule (e.g., an eiCas9 fused to a transcription activator or repressor domain) to alter (e.g., activate or repress) a gene, e.g., RAD50 gene. The targeting domains of gRNAs were selected according to the first tier parameters. The targeting domains bind within 500 bp spanning a transcription start site (TSS), e.g., upstream or downstream of a TSS, have a high level of orthogonality and start with a 5'G. It is contemplated herein that in an embodiment the targeting domain hybridizes to the target domain through complementary base pairing. Any of the targeting domains in the table can be used with a S. pyogenes eiCas9 fusion molecule (e.g., an eiCas9 fused to a transcription activator or repressor domain) to alter (e.g., activate or repress) the RAD50 gene. One or more gRNA may be used to target an eiCas9 fusion molecule to a region spanning 500 bp of a transcription start site (TSS) of the RAD50 gene.

TABLE II.59A

Exemplary HDR-enhancing gRNAs Targeting a RAD50 Gene

| S. pyogenes | A high level of orthogonality, and starts with a G 59A | | | |
|---|---|---|---|---|
| 1st Tier gRNA Name | DNA Strand | Targeting Domain | Target Site Length | Seq ID |
| RAD50-1 | − | GAAGCAGAGGGCUAGGUGCU | 20 | 1808 |
| RAD50-2 | + | GAGAGCGGCGUGGACGCGUG | 20 | 1809 |
| RAD50-3 | − | GCAGCUCCGACUUCCGGGUG | 20 | 1810 |
| RAD50-4 | − | GCCGCUCUCCUGGGGCACGC | 20 | 1811 |
| RAD50-5 | − | GCCGGGAAAUCAGAGUCCCG | 20 | 1812 |
| RAD50-6 | + | GCCGUACCGCACCCGGAAGU | 20 | 1813 |
| RAD50-7 | + | GCGGGGUCGCAUUGUGGCUA | 20 | 1814 |
| RAD50-8 | + | GCGGUUGCGGGGUCGCAUUG | 20 | 1815 |
| RAD50-9 | − | GCGUCCACGCCGCUCUCCUG | 20 | 1816 |
| RAD50-10 | − | GCGUGCGCAGCUCCGACUUC | 20 | 1817 |
| RAD50-11 | + | GCUGUGAGUGCGCGGUUGCG | 20 | 1818 |
| RAD50-12 | + | GGCAGGAAGCUGUGAGUGCG | 20 | 1819 |
| RAD50-13 | + | GGCCCACGUGAUCCGCAGGG | 20 | 1820 |
| RAD50-14 | − | GGCCGCCCUGCGGAUCACGU | 20 | 1821 |
| RAD50-15 | − | GGUGCGGUACGGCGAAGCAG | 20 | 1822 |
| RAD50-16 | − | GGUGCUGGGUGCUGUUGCCA | 20 | 1823 |
| RAD50-17 | − | GGUGCUGUUGCCAGGGGCAG | 20 | 1824 |
| RAD50-18 | − | GUACGGCGAAGCAGAGGGCU | 20 | 1825 |
| RAD50-19 | − | GUGCGGUACGGCGAAGCAGA | 20 | 1826 |
| RAD50-20 | + | GUGGACGCGUGCGGGCCUAG | 20 | 1827 |

Table II.59B provides exemplary targeting domains of gRNAs to be used with an eiCas9 fusion molecule (e.g., an eiCas9 fused to a transcription activator or repressor domain) to alter (e.g., activate or repress) a gene, e.g., RAD50 gene. The targeting domains of gRNAs were selected according to the second tier parameters. The targeting domains bind within 500 bp spanning a transcription start site (TSS), e.g., upstream or downstream of a TSS and have a high level of orthogonality. It is contemplated herein that in an embodiment the targeting domain hybridizes to the target domain through complementary base pairing. Any of the targeting domains in the table can be used with a *S. pyogenes* eiCas9 fusion molecule (e.g., an eiCas9 fused to a transcription activator or repressor domain) to alter (e.g., activate or repress) the RAD50 gene. One or more gRNA may be used to target an eiCas9 fusion molecule to a region spanning 500 bp of a transcription start site (TSS) of the RAD50 gene.

Table II.60A provides exemplary targeting domains of gRNAs to be used with an eiCas9 fusion molecule (e.g., an eiCas9 fused to a transcription activator or repressor domain) to alter (e.g., activate or repress) a gene, e.g., RAD50 gene. The targeting domains of gRNAs were selected according to the first tier parameters. The targeting domains bind within 500 bp spanning a transcription start site (TSS), e.g., upstream or downstream of a TSS, have a high level of orthogonality, start with a 5'G and PAM is NNGRRT. It is contemplated herein that in an embodiment the targeting domain hybridizes to the target domain through complementary base pairing. Any of the targeting domains in the table can be used with a *S. aureus* eiCas9 fusion molecule (e.g., an eiCas9 fused to a transcription activator or repressor domain) to alter (e.g., activate or repress) the RAD50 gene. One or more gRNA may be used to target an eiCas9 fusion molecule to a region spanning 500 bp of a transcription start site (TSS) of the RAD50 gene.

TABLE II.59B

Exemplary HDR-enhancing gRNAs Targeting a RAD50 Gene

S. pyogenes — A high level of orthogonality — 59B

| 2nd Tier gRNA Name | DNA Strand | Targeting Domain | Target Site Length | Seq ID |
|---|---|---|---|---|
| RAD50-21 | + | AAGCUGUGAGUGCGCGGUUG | 20 | 1828 |
| RAD50-22 | + | ACCGCGGGACUCUGAUUUCC | 20 | 1829 |
| RAD50-23 | − | ACGCGUCCACGCCGCUCUCC | 20 | 1830 |
| RAD50-24 | + | AGAGCGGCGUGGACGCGUGC | 20 | 1831 |
| RAD50-25 | + | AGAGGCCCACGUGAUCCGCA | 20 | 1832 |
| RAD50-26 | + | AGCUGUGAGUGCGCGGUUGC | 20 | 1833 |
| RAD50-27 | + | AUCCGCAGGGCGGCCGAGGC | 20 | 1834 |
| RAD50-28 | + | CCCGGCGUGCCCCAGGAGAG | 20 | 1835 |
| RAD50-29 | − | CCGCUCUCCUGGGGCACGCC | 20 | 1836 |
| RAD50-30 | − | CGAAGCAGAGGGCUAGGUGC | 20 | 1837 |
| RAD50-31 | + | CGGAGCUGCGCACGCACCGC | 20 | 1838 |
| RAD50-32 | − | CGGCCGCCCUGCGGAUCACG | 20 | 1839 |
| RAD50-33 | + | CGUGAUCCGCAGGGCGGCCG | 20 | 1840 |
| RAD50-34 | − | CGUGCGCAGCUCCGACUUCC | 20 | 1841 |
| RAD50-35 | + | CUGAUUUCCCGGCGUGCCCC | 20 | 1842 |
| RAD50-36 | + | CUGCUUCGCCGUACCGCACC | 20 | 1843 |
| RAD50-37 | + | UAGAGGCCCACGUGAUCCGC | 20 | 1844 |
| RAD50-38 | − | UCCGACUUCCGGGUGCGGUA | 20 | 1845 |
| RAD50-39 | + | UCGGAGCUGCGCACGCACCG | 20 | 1846 |
| RAD50-40 | − | UGCGGAUCACGUGGGCCUCU | 20 | 1847 |

TABLE II.60A

Exemplary HDR-enhancing gRNAs Targeting a RAD50 Gene

| S. aureus | A high level of orthogonality, starts with a G, PAM is NNGRRT 60A | | | | |
|---|---|---|---|---|---|
| 1st Tier gRNA Name | DNA Strand | Targeting Domain | | Target Site Length | Seq ID |
| RAD50-41 | + | GGAAGCUGUGAGUGCGCGGUUG | | 22 | 1848 |
| RAD50-42 | – | GGUGCGUGCGCAGCUCCGACUU | | 22 | 1849 |

Table II.60B provides exemplary targeting domains of gRNAs to be used with an eiCas9 fusion molecule (e.g., an eiCas9 fused to a transcription activator or repressor domain) to alter (e.g., activate or repress) a gene, e.g., RAD50 gene. The targeting domains of gRNAs were selected according to the second tier parameters. The targeting domains bind within 500 bp spanning a transcription start site (TSS), e.g., upstream or downstream of a TSS, have a high level of orthogonality and PAM is NNGRRT. It is contemplated herein that in an embodiment the targeting domain hybridizes to the target domain through complementary base pairing. Any of the targeting domains in the table can be used with a S. aureus eiCas9 fusion molecule (e.g., an eiCas9 fused to a transcription activator or repressor domain) to alter (e.g., activate or repress) the RAD50 gene. One or more gRNA may be used to target an eiCas9 fusion molecule to a region spanning 500 bp of a transcription start site (TSS) of the RAD50 gene.

TABLE II.60B

Exemplary HDR-enhancing gRNAs Targeting a RAD50 Gene

| S. aureus | A high level of orthogonality, and PAM is NNGRRT 60B | | | | |
|---|---|---|---|---|---|
| 2nd Tier gRNA Name | DNA Strand | Targeting Domain | | Target Site Length | Seq ID |
| RAD50-43 | – | AGCUUCCUGCCUCGGCCGCCCU | | 22 | 1850 |
| RAD50-44 | + | AGGGCGGCCGAGGCAGGAAGCU | | 22 | 1851 |
| RAD50-45 | – | CGGCGAAGCAGAGGGCUAGGUG | | 22 | 1852 |
| RAD50-46 | – | CUCCUGGGGCACGCCGGGAAAU | | 22 | 1853 |

Table II.61A provides exemplary targeting domains of gRNAs to be used with an eiCas9 fusion molecule (e.g., an eiCas9 fused to a transcription activator or repressor domain) to alter (e.g., activate or repress) a gene, e.g., NBN gene. The targeting domains of gRNAs were selected according to the first tier parameters. The targeting domains bind within 500 bp spanning a transcription start site (TSS), e.g., upstream or downstream of a TSS, have a high level of orthogonality and start with a 5'G. It is contemplated herein that in an embodiment the targeting domain hybridizes to the target domain through complementary base pairing. Any of the targeting domains in the table can be used with a S. pyogenes eiCas9 fusion molecule (e.g., an eiCas9 fused to a transcription activator or repressor domain) to alter (e.g., activate or repress) the NBN gene. One or more gRNA may be used to target an eiCas9 fusion molecule to a region spanning 500 bp of a transcription start site (TSS) of the NBN gene.

TABLE II.61A

Exemplary HDR-enhancing gRNAs Targeting a NBN Gene

| S. pyogenes | A high level of orthogonality, and starts with a G 61A | | | | |
|---|---|---|---|---|---|
| 1st Tier gRNA Name | DNA Strand | Targeting Domain | | Target Site Length | Seq ID |
| NBN-1 | – | GAGCGCGGAUACGGCGCCUG | | 20 | 1854 |
| NBN-2 | – | GAUGAGGCGGGAGUGCGACU | | 20 | 1855 |

TABLE II.61A-continued

Exemplary HDR-enhancing gRNAs Targeting a NBN Gene

S. pyogenes: A high level of orthogonality, and starts with a G — 61A

| 1st Tier gRNA Name | DNA Strand | Targeting Domain | Target Site Length | Seq ID |
|---|---|---|---|---|
| NBN-3 | − | GCAGGCUGCCUUGGAUGAGG | 20 | 1856 |
| NBN-4 | − | GCGGAUACGGCGCCUGCGGU | 20 | 1857 |
| NBN-5 | − | GGCGCUUGCCCGCCACCUGG | 20 | 1858 |
| NBN-6 | − | GGGAGCCACGCAGGCUGCCU | 20 | 1859 |
| NBN-7 | − | GUUAAAAGGGUAUGUUUCUA | 20 | 1860 |

Table II.61B provides exemplary targeting domains of gRNAs to be used with an eiCas9 fusion molecule (e.g., an eiCas9 fused to a transcription activator or repressor domain) to alter (e.g., activate or repress) a gene, e.g., NBN gene. The targeting domains of gRNAs were selected according to the second tier parameters. The targeting domains bind within 500 bp spanning a transcription start site (TSS), e.g., upstream or downstream of a TSS and have a high level of orthogonality. It is contemplated herein that in an embodiment the targeting domain hybridizes to the target domain through complementary base pairing. Any of the targeting domains in the table can be used with a S. pyogenes eiCas9 fusion molecule (e.g., an eiCas9 fused to a transcription activator or repressor domain) to alter (e.g., activate or repress) the NBN gene. One or more gRNA may be used to target an eiCas9 fusion molecule to a region spanning 500 bp of a transcription start site (TSS) of the NBN gene.

TABLE II.61B

Exemplary HDR-enhancing gRNAs Targeting a NBN Gene

S. pyogenes: A high level of orthogonality — 61B

| 2nd Tier gRNA Name | DNA Strand | Targeting Domain | Target Site Length | Seq ID |
|---|---|---|---|---|
| NBN-8 | − | ACGGCGCCUGCGGUCGGCAU | 20 | 1861 |
| NBN-9 | − | AUGAGGCGGGAGUGCGACUU | 20 | 1862 |
| NBN-10 | − | CACGCAGGCUGCCUUGGAUG | 20 | 1863 |
| NBN-11 | − | CAGGCUGCCUUGGAUGAGGC | 20 | 1864 |
| NBN-12 | + | CCGGAGCCCAUGCCGACCGC | 20 | 1865 |
| NBN-13 | − | CCUGCGGUCGGCAUGGGCUC | 20 | 1866 |
| NBN-14 | − | CUAAGGUGUCGCUGAAUGUA | 20 | 1867 |
| NBN-15 | + | CUCAUCCAAGGCAGCCUGCG | 20 | 1868 |
| NBN-16 | − | CUGCGGUCGGCAUGGGCUCC | 20 | 1869 |
| NBN-17 | − | CUGCUAGACGAGCGCGGAUA | 20 | 1870 |
| NBN-18 | + | CUGUUCCUUUUCCAACCACC | 20 | 1871 |
| NBN-19 | − | CUUGCCCGCCACCUGGUGGU | 20 | 1872 |
| NBN-20 | + | CUUUUCCAACCACCAGGUGG | 20 | 1873 |
| NBN-21 | − | UACGGCGCCUGCGGUCGGCA | 20 | 1874 |
| NBN-22 | + | UCCCGGGAGCGCGCACGUCC | 20 | 1875 |
| NBN-23 | − | UCCGGGACGUGCGCGCUCCC | 20 | 1876 |
| NBN-24 | + | UCGCACUCCCGCCUCAUCCA | 20 | 1877 |
| NBN-25 | − | UGAAAUGUGCUGCGUUAAAA | 20 | 1878 |

TABLE II.61B-continued

Exemplary HDR-enhancing gRNAs Targeting a NBN Gene

| S. pyogenes | | A high level of orthogonality 61B | | |
|---|---|---|---|---|
| 2nd Tier gRNA Name | DNA Strand | Targeting Domain | Target Site Length | Seq ID |
| NBN-26 | – | UUGAAAUGUGCUGCGUUAAA | 20 | 1879 |
| NBN-27 | – | UUGGGCGCUUGCCCGCCACC | 20 | 1880 |

Table II.62A provides exemplary targeting domains of gRNAs to be used with an eiCas9 fusion molecule (e.g., an eiCas9 fused to a transcription activator or repressor domain) to alter (e.g., activate or repress) a gene, e.g., NBN gene. The targeting domains of gRNAs were selected according to the first tier parameters. The targeting domains bind within 500 bp spanning a transcription start site (TSS), e.g., upstream or downstream of a TSS, have a high level of orthogonality, start with a 5'G and PAM is NNGRRT. It is contemplated herein that in an embodiment the targeting domain hybridizes to the target domain through complementary base pairing. Any of the targeting domains in the table can be used with a S. aureus eiCas9 fusion molecule (e.g., an eiCas9 fused to a transcription activator or repressor domain) to alter (e.g., activate or repress) the NBN gene. One or more gRNA may be used to target an eiCas9 fusion molecule to a region spanning 500 bp of a transcription start site (TSS) of the NBN gene.

TABLE II.62A

Exemplary HDR-enhancing gRNA Targeting a NBN Gene

| S. aureus | | A high level of orthogonality, starts with a G, PAM is NNGRRT 62A | | |
|---|---|---|---|---|
| 1st Tier gRNA Name | DNA Strand | Targeting Domain | Target Site Length | Seq ID |
| NBN-28 | – | GUAUUGAAAUGUGCUGCGUUAA | 22 | 1881 |

Table II.62B provides exemplary targeting domains of gRNAs to be used with an eiCas9 fusion molecule (e.g., an eiCas9 fused to a transcription activator or repressor domain) to alter (e.g., activate or repress) a gene, e.g., NBN gene. The targeting domains of gRNAs were selected according to the second tier parameters. The targeting domains bind within 500 bp spanning a transcription start site (TSS), e.g., upstream or downstream of a TSS, have a high level of orthogonality and PAM is NNGRRT. It is contemplated herein that in an embodiment the targeting domain hybridizes to the target domain through complementary base pairing. Any of the targeting domains in the table can be used with a S. aureus eiCas9 fusion molecule (e.g., an eiCas9 fused to a transcription activator or repressor domain) to alter (e.g., activate or repress) the NBN gene. One or more gRNA may be used to target an eiCas9 fusion molecule to a region spanning 500 bp of a transcription start site (TSS) of the NBN gene.

TABLE II.62B

Exemplary HDR-enhancing gRNAs Targeting a NBN Gene

| S. aureus | | A high level of orthogonality, and PAM is NNGRRT 62B | | |
|---|---|---|---|---|
| 2nd Tier gRNA Name | DNA Strand | Targeting Domain | Target Site Length | Seq ID |
| NBN-29 | – | AGGGUAUGUUUCUAAGGUGUCG | 22 | 1882 |
| NBN-30 | – | CCCGGGAGCCACGCAGGCUGCC | 22 | 1883 |
| NBN-31 | – | CGCAGGCUGCCUUGGAUGAGGC | 22 | 1884 |

Table II.63A provides exemplary targeting domains of gRNAs to be used with an eiCas9 fusion molecule (e.g., an eiCas9 fused to a transcription activator or repressor domain) to alter (e.g., activate or repress) a gene, e.g., MSH2 gene. The targeting domains of gRNAs were selected according to the first tier parameters. The targeting domains bind within 500 bp spanning a transcription start site (TSS), e.g., upstream or downstream of a TSS, have a high level of orthogonality and start with a 5'G. It is contemplated herein that in an embodiment the targeting domain hybridizes to the target domain through complementary base pairing. Any of the targeting domains in the table can be used with a *S. pyogenes* eiCas9 fusion molecule (e.g., an eiCas9 fused to a transcription activator or repressor domain) to alter (e.g., activate or repress) the MSH2 gene. One or more gRNA may be used to target an eiCas9 fusion molecule to a region spanning 500 bp of a transcription start site (TSS) of the MSH2 gene.

Table II.63B provides exemplary targeting domains of gRNAs to be used with an eiCas9 fusion molecule (e.g., an eiCas9 fused to a transcription activator or repressor domain) to alter (e.g., activate or repress) a gene, e.g., MSH2 gene. The targeting domains of gRNAs were selected according to the second tier parameters. The targeting domains bind within 500 bp spanning a transcription start site (TSS), e.g., upstream or downstream of a TSS and have a high level of orthogonality. It is contemplated herein that in an embodiment the targeting domain hybridizes to the target domain through complementary base pairing. Any of the targeting domains in the table can be used with a *S. pyogenes* eiCas9 fusion molecule (e.g., an eiCas9 fused to a transcription activator or repressor domain) to alter (e.g., activate or repress) the MSH2 gene. One or more gRNA may be used to target an eiCas9 fusion molecule to a region spanning 500 bp of a transcription start site (TSS) of the MSH2 gene.

TABLE II.63A

Exemplary HDR-enhancing gRNAs Targeting a MSH2 Gene

*S. pyogenes*: A high level of orthogonality, and starts with a G — 63A

| 1st Tier gRNA Name | DNA Strand | Targeting Domain | Target Site Length | Seq ID |
|---|---|---|---|---|
| MSH2-1 | + | GAAACAGCUUAGUGGGUGUG | 20 | 1885 |
| MSH2-2 | + | GAGGCGGGAAACAGCUUAGU | 20 | 1886 |
| MSH2-3 | + | GCAGCUGAGUAAACACAGAA | 20 | 1887 |
| MSH2-4 | − | GCCCAGCUUCCCGCGCACGC | 20 | 1888 |
| MSH2-5 | + | GCCGCUCGGGGACGUGGGA | 20 | 1889 |
| MSH2-6 | + | GCCGUGGCCGGACGCCGCUC | 20 | 1890 |
| MSH2-7 | + | GCUAAAGUCACCAGCGUGCG | 20 | 1891 |
| MSH2-8 | − | GCUGCAAGGCUUGAAGCCCC | 20 | 1892 |
| MSH2-9 | + | GGAAACAGCUUAGUGGGUGU | 20 | 1893 |
| MSH2-10 | + | GGACGCCGCUCGGGGACGU | 20 | 1894 |
| MSH2-11 | + | GGAGGCGGGAAACAGCUUAG | 20 | 1895 |
| MSH2-12 | + | GGGAAACAGCUUAGUGGGUG | 20 | 1896 |
| MSH2-13 | + | GGGCCGCGUCUGCUUAUGAU | 20 | 1897 |
| MSH2-14 | + | GGGGACGUGGGAGGGGAGGC | 20 | 1898 |
| MSH2-15 | + | GGGGGACGUGGGAGGGGAGG | 20 | 1899 |
| MSH2-16 | − | GGUGGGGUGUAUGCAAGGGU | 20 | 1900 |

TABLE II.63B

Exemplary HDR-enhancing gRNAs Targeting a MSH2 Gene

S. pyogenes — A high level of orthogonality 63B

| 2nd Tier gRNA Name | DNA Strand | Targeting Domain | Target Site Length | Seq ID |
|---|---|---|---|---|
| MSH2-17 | + | ACCAGCGUGCGCGGGAAGCU | 20 | 1901 |
| MSH2-18 | - | AGGGCUGCGUUUCGGUGGGU | 20 | 1902 |
| MSH2-19 | - | AUGCCUGCGCCUAGGUCGCG | 20 | 1903 |
| MSH2-20 | - | CAACCAAUCAUAAGCAGACG | 20 | 1904 |
| MSH2-21 | - | CACGUCCCCGAGCGGCGUC | 20 | 1905 |
| MSH2-22 | - | CAGGGCUGCGUUUCGGUGGG | 20 | 1906 |
| MSH2-23 | - | CCCCGAGCGGCGUCCGGCCA | 20 | 1907 |
| MSH2-24 | + | CCGCUCGGGGACGUGGGAG | 20 | 1908 |
| MSH2-25 | + | CCGUGGCCGGACGCCGCUCG | 20 | 1909 |
| MSH2-26 | + | CGCCGUGGCCGGACGCCGCU | 20 | 1910 |
| MSH2-27 | + | CGUGGCCGGACGCCGCUCGG | 20 | 1911 |
| MSH2-28 | + | CUAAAGUCACCAGCGUGCGC | 20 | 1912 |
| MSH2-29 | + | CUACUAAGGAUGCGCGUCUG | 20 | 1913 |
| MSH2-30 | + | CUGAUUGGGUGUGGUCGCCG | 20 | 1914 |
| MSH2-31 | + | CUGCUUAUGAUUGGUUGCCG | 20 | 1915 |
| MSH2-32 | + | UACUAAGGAUGCGCGUCUGC | 20 | 1916 |
| MSH2-33 | - | UACUGCGCAUGCCUGCGCCU | 20 | 1917 |
| MSH2-34 | + | UGCGGGUUUCCGCGCGACCU | 20 | 1918 |
| MSH2-35 | + | UUGGGUGUGGUCGCCGUGGC | 20 | 1919 |
| MSH2-36 | + | UUUCCGCGCGACCUAGGCGC | 20 | 1920 |

Table II.64A provides exemplary targeting domains of gRNAs to be used with an eiCas9 fusion molecule (e.g., an eiCas9 fused to a transcription activator or repressor domain) to alter (e.g., activate or repress) a gene, e.g., MSH2 gene. The targeting domains of gRNAs were selected according to the first tier parameters. The targeting domains bind within 500 bp spanning a transcription start site (TSS), e.g., upstream or downstream of a TSS, have a high level of orthogonality, start with a 5'G and PAM is NNGRRT. It is contemplated herein that in an embodiment the targeting domain hybridizes to the target domain through complementary base pairing. Any of the targeting domains in the table can be used with a S. aureus eiCas9 fusion molecule (e.g., an eiCas9 fused to a transcription activator or repressor domain) to alter (e.g., activate or repress) the MSH2 gene. One or more gRNA may be used to target an eiCas9 fusion molecule to a region spanning 500 bp of a transcription start site (TSS) of the MSH2 gene.

TABLE II.64A

Exemplary HDR-enhancing gRNAs Targeting a MSH2 Gene

S. aureus — A high level of orthogonality, starts with a G, PAM is NNGRRT 64A

| 1st Tier gRNA Name | DNA Strand | Targeting Domain | Target Site Length | Seq ID |
|---|---|---|---|---|
| MSH2-37 | + | GAAACGCAGCCCUGGAAGCUGA | 22 | 1921 |
| MSH2-38 | + | GCGGGAAACAGCUUAGUGGGUG | 22 | 1922 |
| MSH2-39 | + | GCUCUACUAAGGAUGCGCGUCU | 22 | 1923 |

Table II.64B provides exemplary targeting domains of gRNAs to be used with an eiCas9 fusion molecule (e.g., an eiCas9 fused to a transcription activator or repressor domain) to alter (e.g., activate or repress) a gene, e.g., MSH2 gene. The targeting domains of gRNAs were selected according to the second tier parameters. The targeting domains bind within 500 bp spanning a transcription start site (TSS), e.g., upstream or downstream of a TSS, have a high level of orthogonality and PAM is NNGRRT. It is contemplated herein that in an embodiment the targeting domain hybridizes to the target domain through complementary base pairing. Any of the targeting domains in the table can be used with a S. aureus eiCas9 fusion molecule (e.g., an eiCas9 fused to a transcription activator or repressor domain) to alter (e.g., activate or repress) the MSH2 gene. One or more gRNA may be used to target an eiCas9 fusion molecule to a region spanning 500 bp of a transcription start site (TSS) of the MSH2 gene.

TABLE II.64B

Exemplary HDR-enhancing gRNAs Targeting a MSH2 Gene

S. aureus — A high level of orthogonality, and PAM is NNGRRT — 64B

| 2nd Tier gRNA Name | DNA Strand | Targeting Domain | Target Site Length | Seq ID |
|---|---|---|---|---|
| MSH2-40 | + | AAACACAGAAAGGAGCUCUACU | 22 | 1924 |
| MSH2-41 | - | AGCCCCUGGGUGGGUGUAUGC | 22 | 1925 |
| MSH2-42 | + | AGGGGAGGCGGGAAACAGCUUA | 22 | 1926 |
| MSH2-43 | - | CAGCUUCCAGGGCUGCGUUUCG | 22 | 1927 |
| MSH2-44 | - | CCAGGGCUGCGUUUCGGUGGGU | 22 | 1928 |
| MSH2-45 | + | CCAGGGGCUUCAAGCCUUGCAG | 22 | 1929 |
| MSH2-46 | - | UCAGCUGCAAGGCUUGAAGCCC | 22 | 1930 |
| MSH2-47 | - | UGCAAGGCUUGAAGCCCCUGGG | 22 | 1931 |

Table II.65A provides exemplary targeting domains of gRNAs to be used with an eiCas9 fusion molecule (e.g., an eiCas9 fused to a transcription activator or repressor domain) to alter (e.g., activate or repress) a gene, e.g., MSH3 gene. The targeting domains of gRNAs were selected according to the first tier parameters. The targeting domains bind within 500 bp spanning a transcription start site (TSS), e.g., upstream or downstream of a TSS, have a high level of orthogonality and start with a 5'G. It is contemplated herein that in an embodiment the targeting domain hybridizes to the target domain through complementary base pairing. Any of the targeting domains in the table can be used with a S. pyogenes eiCas9 fusion molecule (e.g., an eiCas9 fused to a transcription activator or repressor domain) to alter (e.g., activate or repress) the MSH3 gene. One or more gRNA may be used to target an eiCas9 fusion molecule to a region spanning 500 bp of a transcription start site (TSS) of the MSH3 gene.

TABLE II.65A

Exemplary HDR-enhancing gRNAs Targeting a MSH3 Gene

S. pyogenes — A high level of orthogonality, and starts with a G — 65A

| 1st Tier gRNA Name | DNA Strand | Targeting Domain | Target Site Length | Seq ID |
|---|---|---|---|---|
| MSH3-1 | - | GACCCUGCGUGCGCCGGGGC | 20 | 1932 |
| MSH3-2 | - | GAGACAUGGCAGGGCAAGGA | 20 | 1933 |
| MSH3-3 | + | GAGGCCCCGCCCCCCCGCCC | 20 | 1934 |
| MSH3-4 | - | GCAGGGCAAGGAUGGCAGCC | 20 | 1935 |
| MSH3-5 | - | GCCGCGACCCUGCGUGCGCC | 20 | 1936 |

TABLE II.65A-continued

Exemplary HDR-enhancing gRNAs Targeting a MSH3 Gene

S. pyogenes — A high level of orthogonality, and starts with a G
65A

| 1st Tier gRNA Name | DNA Strand | Targeting Domain | Target Site Length | Seq ID |
|---|---|---|---|---|
| MSH3-6 | − | GCCUGCACAAAUGGGGACGA | 20 | 1937 |
| MSH3-7 | + | GCGGGCUCGCGCUCCUCGCC | 20 | 1938 |
| MSH3-8 | + | GCUCGCGCCCGCAGACGCCU | 20 | 1939 |
| MSH3-9 | − | GCUUCCGGCGAGACAUGGCA | 20 | 1940 |
| MSH3-10 | − | GGCAGCCCGGCGGCAGGGCC | 20 | 1941 |
| MSH3-11 | − | GGCUUCCGGCGAGACAUGGC | 20 | 1942 |
| MSH3-12 | − | GGGCAAGGAUGGCAGCCCGG | 20 | 1943 |
| MSH3-13 | − | GGGCCUCGCCUGCACAAAUG | 20 | 1944 |
| MSH3-14 | − | GGGGCCUCGCCUGCACAAAU | 20 | 1945 |
| MSH3-15 | + | GUCUCGCCGGAAGCCUGCGU | 20 | 1946 |
| MSH3-16 | − | GUGCGCCGGGCGGGGGGGC | 20 | 1947 |

Table II.65B provides exemplary targeting domains of gRNAs to be used with an eiCas9 fusion molecule (e.g., an eiCas9 fused to a transcription activator or repressor domain) to alter (e.g., activate or repress) a gene, e.g., MSH3 gene. The targeting domains of gRNAs were selected according to the second tier parameters. The targeting domains bind within 500 bp spanning a transcription start site (TSS), e.g., upstream or downstream of a TSS and have a high level of orthogonality. It is contemplated herein that in an embodiment the targeting domain hybridizes to the target domain through complementary base pairing. Any of the targeting domains in the table can be used with a S. pyogenes eiCas9 fusion molecule (e.g., an eiCas9 fused to a transcription activator or repressor domain) to alter (e.g., activate or repress) the MSH3 gene. One or more gRNA may be used to target an eiCas9 fusion molecule to a region spanning 500 bp of a transcription start site (TSS) of the MSH3 gene.

TABLE II.65B

Exemplary HDR-enhancing gRNAs Targeting a MSH3 Gene

S. pyogenes — A high level of orthogonality
65B

| 2nd Tier gRNA Name | DNA Strand | Targeting Domain | Target Site Length | Seq ID |
|---|---|---|---|---|
| MSH3-17 | − | AAGGAUGGCAGCCCGGCGGC | 20 | 1948 |
| MSH3-18 | + | ACGCCUGGGAACUGCGGCCG | 20 | 1949 |
| MSH3-19 | − | AGGAUGGCAGCCCGGCGGCA | 20 | 1950 |
| MSH3-20 | − | CAAAUGGGGACGAGGGGGGC | 20 | 1951 |
| MSH3-21 | + | CCCCGGCGCACGCAGGGUCG | 20 | 1952 |
| MSH3-22 | + | CCGCAGACGCCUGGGAACUG | 20 | 1953 |
| MSH3-23 | − | CCGCAGUUCCCAGGCGUCUG | 20 | 1954 |
| MSH3-24 | − | CCGCGACCCUGCGUGCGCCG | 20 | 1955 |
| MSH3-25 | − | CCUGCACAAAUGGGGACGAG | 20 | 1956 |
| MSH3-26 | − | CGACCCUGCGUGCGCCGGGG | 20 | 1957 |
| MSH3-27 | − | CGCAGGCUUCCGGCGAGACA | 20 | 1958 |
| MSH3-28 | − | CGCAGUUCCCAGGCGUCUGC | 20 | 1959 |
| MSH3-29 | − | CGCCGCGACCCUGCGUGCGC | 20 | 1960 |

TABLE II.65B-continued

Exemplary HDR-enhancing gRNAs Targeting a MSH3 Gene

S. pyogenes — A high level of orthogonality 65B

| 2nd Tier gRNA Name | DNA Strand | Targeting Domain | Target Site Length | Seq ID |
|---|---|---|---|---|
| MSH3-30 | − | CGCCUGCACAAAUGGGGACG | 20 | 1961 |
| MSH3-31 | + | CGCCUGGGAACUGCGGCCGC | 20 | 1962 |
| MSH3-32 | + | CGUCCCCAUUUGUGCAGGCG | 20 | 1963 |
| MSH3-33 | + | CUUGCCCUGCCAUGUCUCGC | 20 | 1964 |
| MSH3-34 | + | UCAAGUUUGGCGCGAAAUUG | 20 | 1965 |
| MSH3-35 | + | UCUCGCCGGAAGCCUGCGUC | 20 | 1966 |
| MSH3-36 | − | UGGCGAGGAGCGCGAGCCCG | 20 | 1967 |

Table II.66 provides exemplary targeting domains of gRNAs to be used with an eiCas9 fusion molecule (e.g., an eiCas9 fused to a transcription activator or repressor domain) to alter (e.g., activate or repress) a gene, e.g., MSH3 gene. The targeting domains of gRNAs were selected according to the second tier parameters. The targeting domains bind within 500 bp spanning a transcription start site (TSS), e.g., upstream or downstream of a TSS, have a high level of orthogonality and PAM is NNGRRT. It is contemplated herein that in an embodiment the targeting domain hybridizes to the target domain through complementary base pairing. Any of the targeting domains in the table can be used with a S. aureus eiCas9 fusion molecule (e.g., an eiCas9 fused to a transcription activator or repressor domain) to alter (e.g., activate or repress) the MSH3 gene. One or more gRNA may be used to target an eiCas9 fusion molecule to a region spanning 500 bp of a transcription start site (TSS) of the MSH3 gene.

TABLE II.66A

Exemplary HDR-enhancing gRNAs Targeting a MSH3 Gene

S. aureus — A high level of orthogonality, and PAM is NNGRRT 66B

| 2nd Tier gRNA Name | DNA Strand | Targeting Domain | Target Site Length | Seq ID |
|---|---|---|---|---|
| MSH3-37 | + | CGCCCCCCCGCCCCGGCGCACG | 22 | 1968 |
| MSH3-38 | − | UUCCGGCGAGACAUGGCAGGGC | 22 | 1969 |

Table II.67A provides exemplary targeting domains of gRNAs to be used with an eiCas9 fusion molecule (e.g., an eiCas9 fused to a transcription activator or repressor domain) to alter (e.g., activate or repress) a gene, e.g., MSH6 gene. The targeting domains of gRNAs were selected according to the first tier parameters. The targeting domains bind within 500 bp spanning a transcription start site (TSS), e.g., upstream or downstream of a TSS, have a high level of orthogonality and start with a 5'G. It is contemplated herein that in an embodiment the targeting domain hybridizes to the target domain through complementary base pairing. Any of the targeting domains in the table can be used with a S. pyogenes eiCas9 fusion molecule (e.g., an eiCas9 fused to a transcription activator or repressor domain) to alter (e.g., activate or repress) the MSH6 gene. One or more gRNA may be used to target an eiCas9 fusion molecule to a region spanning 500 bp of a transcription start site (TSS) of the MSH6 gene.

TABLE II.67A

Exemplary HDR-enhancing gRNAs Targeting a MSH6 Gene

A high level of orthogonality, and starts with a G 67A

| S. pyogenes 1st Tier gRNA Name | DNA Strand | Targeting Domain | Target Site Length | Seq ID |
|---|---|---|---|---|
| MSH6-1 | − | GACGUGGGGAAGGGCGGGGC | 20 | 1970 |
| MSH6-2 | + | GCGCCUGUUGAUUGGCCACU | 20 | 1971 |
| MSH6-3 | − | GCGCGCGGCGACGUGGGGAA | 20 | 1972 |
| MSH6-4 | − | GCGCUCCGCCGGAGGAACCC | 20 | 1973 |
| MSH6-5 | − | GCGGCGACGUGGGGAAGGGC | 20 | 1974 |
| MSH6-6 | − | GCUCCUGCUGGCGGGAAAUC | 20 | 1975 |
| MSH6-7 | − | GCUGGCACACUGGUGGGUAG | 20 | 1976 |
| MSH6-8 | − | GGCACACUGGUGGGUAGGGG | 20 | 1977 |
| MSH6-9 | − | GGCCCCAGUGGCCAAUCAAC | 20 | 1978 |
| MSH6-10 | − | GGCGCCUCGCCGUGCGCGGG | 20 | 1979 |
| MSH6-11 | + | GGCGCCUGUUGAUUGGCCAC | 20 | 1980 |
| MSH6-12 | − | GGCGGGGCUGGCACACUGGU | 20 | 1981 |
| MSH6-13 | − | GGCUGGCACACUGGUGGGUA | 20 | 1982 |
| MSH6-14 | − | GGCUGGCACGCUGGCGGUGA | 20 | 1983 |
| MSH6-15 | − | GGGCUGGCACACUGGUGGGU | 20 | 1984 |
| MSH6-16 | − | GGGCUGGCACGCUGGCGGUG | 20 | 1985 |

TABLE II.67A-continued

Exemplary HDR-enhancing gRNAs Targeting a MSH6 Gene

A high level of orthogonality, and starts with a G
67A

| S. pyogenes 1st Tier gRNA Name | DNA Strand | Targeting Domain | Target Site Length | Seq ID |
|---|---|---|---|---|
| MSH6-17 | - | GGGGAGGCGCGCUCCGCCGG | 20 | 1986 |
| MSH6-18 | + | GUCGCCGCGCGCCCGGGGGC | 20 | 1987 |
| MSH6-19 | - | GUGCGCGGGCGGUGCGCGCC | 20 | 1988 |
| MSH6-20 | + | GUUGAUUGGCCACUGGGGCC | 20 | 1989 |

Table II.67B provides exemplary targeting domains of gRNAs to be used with an eiCas9 fusion molecule (e.g., an eiCas9 fused to a transcription activator or repressor domain) to alter (e.g., activate or repress) a gene, e.g., MSH6 gene. The targeting domains of gRNAs were selected according to the second tier parameters. The targeting domains bind within 500 bp spanning a transcription start site (TSS), e.g., upstream or downstream of a TSS and have a high level of orthogonality. It is contemplated herein that in an embodiment the targeting domain hybridizes to the target domain through complementary base pairing. Any of the targeting domains in the table can be used with a *S. pyogenes* eiCas9 fusion molecule (e.g., an eiCas9 fused to a transcription activator or repressor domain) to alter (e.g., activate or repress) the MSH6 gene. One or more gRNA may be used to target an eiCas9 fusion molecule to a region spanning 500 bp of a transcription start site (TSS) of the MSH6 gene.

TABLE II.67B

Exemplary HDR-enhancing gRNAs Targeting a MSH6 Gene

A high level of orthogonality
S. pyogenes 67B

| 2nd Tier gRNA Name | DNA Strand | Targeting Domain | Target Site Length | Seq ID |
|---|---|---|---|---|
| MSH6-21 | - | AAAGCACCGCAUCUACCGCG | 20 | 1990 |
| MSH6-22 | - | AACAGGCGCCUCGCCGUGCG | 20 | 1991 |
| MSH6-23 | - | ACAGGCGCCUCGCCGUGCGC | 20 | 1992 |
| MSH6-24 | - | ACCGCGCGGCUCCUGCUGGC | 20 | 1993 |
| MSH6-25 | + | ACGGCGAGGCGCCUGUUGAU | 20 | 1994 |
| MSH6-26 | - | AUCUACCGCGCGGCUCCUGC | 20 | 1995 |
| MSH6-27 | + | CAGGAGCCGCGCGGUAGAUG | 20 | 1996 |
| MSH6-28 | + | CCCCCAGAUUUCCCGCCAGC | 20 | 1997 |
| MSH6-29 | - | CCCCCGGGCGCGCGGCGACG | 20 | 1998 |
| MSH6-30 | - | CCCCGGGCGCGCGGCGACGU | 20 | 1999 |
| MSH6-31 | + | CGCACCGCCCGCGCACGGCG | 20 | 2000 |
| MSH6-32 | + | CGCCUGUUGAUUGGCCACUG | 20 | 2001 |

TABLE II.67B-continued

Exemplary HDR-enhancing gRNAs Targeting a MSH6 Gene

A high level of orthogonality
S. pyogenes 67B

| 2nd Tier gRNA Name | DNA Strand | Targeting Domain | Target Site Length | Seq ID |
|---|---|---|---|---|
| MSH6-33 | - | CGCGCUCCGCCGGAGGAACC | 20 | 2002 |
| MSH6-34 | - | CGCGGCGACGUGGGGAAGGG | 20 | 2003 |
| MSH6-35 | - | CGGAGGAACCCGGGCCCCAG | 20 | 2004 |
| MSH6-36 | + | CGUCGCCGCGCGCCCGGGGG | 20 | 2005 |
| MSH6-37 | - | CUGGCGGGAAAUCUGGGGGG | 20 | 2006 |
| MSH6-38 | - | UACCGCGCGGCUCCUGCUGG | 20 | 2007 |
| MSH6-39 | + | UGGCGCGCACCGCCCGCGCA | 20 | 2008 |
| MSH6-40 | + | UGGGGCCCGGGUUCCUCCGG | 20 | 2009 |

Table II.68A provides exemplary targeting domains of gRNAs to be used with an eiCas9 fusion molecule (e.g., an eiCas9 fused to a transcription activator or repressor domain) to alter (e.g., activate or repress) a gene, e.g., MSH6 gene. The targeting domains of gRNAs were selected according to the first tier parameters. The targeting domains bind within 500 bp spanning a transcription start site (TSS), e.g., upstream or downstream of a TSS, have a high level of orthogonality, start with a 5'G and PAM is NNGRRT. It is contemplated herein that in an embodiment the targeting domain hybridizes to the target domain through complementary base pairing. Any of the targeting domains in the table can be used with a *S. aureus* eiCas9 fusion molecule (e.g., an eiCas9 fused to a transcription activator or repressor domain) to alter (e.g., activate or repress) the MSH6 gene. One or more gRNA may be used to target an eiCas9 fusion molecule to a region spanning 500 bp of a transcription start site (TSS) of the MSH6 gene.

TABLE II.68A

Exemplary HDR-enhancing gRNA Targeting a MSH6 Gene

A high level of orthogonality, starts with a G, PAM is NNGRRT
S. aureus 68A

| 1st Tier gRNA Name | DNA Strand | Targeting Domain | Target Site Length | Seq ID |
|---|---|---|---|---|
| MSH6-41 | - | GAAGGGCGGGGCUGGCACACUG | 22 | 2010 |

Table II.68B provides exemplary targeting domains of gRNAs to be used with an eiCas9 fusion molecule (e.g., an eiCas9 fused to a transcription activator or repressor domain) to alter (e.g., activate or repress) a gene, e.g., MSH6 gene. The targeting domains of gRNAs were selected according to the second tier parameters. The targeting domains bind within 500 bp spanning a transcription start site (TSS), e.g., upstream or downstream of a TSS, have a high level of orthogonality and PAM is NNGRRT. It is contemplated herein that in an embodiment the targeting domain hybridizes to the target domain through complementary base pairing. Any of the targeting domains in the table can be used with a *S. aureus* eiCas9 fusion molecule (e.g., an eiCas9 fused to a transcription activator or repressor domain) to alter (e.g., activate or repress) the MSH6 gene. One or more gRNA may be used to target an eiCas9 fusion molecule to a region spanning 500 bp of a transcription start site (TSS) of the MSH6 gene.

TABLE II.68B

Exemplary HDR-enhancing gRNAs Targeting a MSH6 Gene

*S. aureus*: A high level of orthogonality, and PAM is NNGRRT — 68B

| 2nd Tier gRNA Name | DNA Strand | Targeting Domain | Target Site Length | Seq ID |
|---|---|---|---|---|
| MSH6-42 | + | CCUGUUGAUUGGCCACUGGGGC | 22 | 2011 |

Table II.69A provides exemplary targeting domains of gRNAs to be used with an eiCas9 fusion molecule (e.g., an eiCas9 fused to a transcription activator or repressor domain) to alter (e.g., activate or repress) a gene, e.g., M1H1 gene. The targeting domains of gRNAs were selected according to the first tier parameters. The targeting domains bind within 500 bp spanning a transcription start site (TSS), e.g., upstream or downstream of a TSS, have a high level of orthogonality and start with a 5'G. It is contemplated herein that in an embodiment the targeting domain hybridizes to the target domain through complementary base pairing. Any of the targeting domains in the table can be used with a *S. pyogenes* eiCas9 fusion molecule (e.g., an eiCas9 fused to a transcription activator or repressor domain) to alter (e.g., activate or repress) the M1H1 gene. One or more gRNA may be used to target an eiCas9 fusion molecule to a region spanning 500 bp of a transcription start site (TSS) of the M1H1 gene.

TABLE II.69A

Exemplary HDR-enhancing gRNAs Targeting a M1H1 Gene

*S. pyogenes*: A high level of orthogonality, and starts with a G — 69A

| 1st Tier gRNA Name | DNA Strand | Targeting Domain | Target Site Length | Seq ID |
|---|---|---|---|---|
| MLH1-1 | + | GACAGUGGUGAACCGCAUCG | 20 | 2012 |
| MLH1-2 | − | GACUGGCACGUCAGGGAACC | 20 | 2013 |
| MLH1-3 | + | GCACGAGGCACUGAGGUGAU | 20 | 2014 |
| MLH1-4 | + | GCCAAAAUGUCGUUCGUGGC | 20 | 2015 |
| MLH1-5 | + | GCGCAAGCGCAUAUCCUUCU | 20 | 2016 |
| MLH1-6 | + | GCGCAUGCCCACAACGGCGG | 20 | 2017 |
| MLH1-7 | − | GCGCUGUACAUGCCUCUGCC | 20 | 2018 |
| MLH1-8 | + | GCGGACACGCCUCUUUGCCC | 20 | 2019 |
| MLH1-9 | − | GCUACUGCCCGCUACCUAGA | 20 | 2020 |
| MLH1-10 | + | GCUCCUAAAAACGAACCAAU | 20 | 2021 |
| MLH1-11 | − | GGAAACGUCUAGAUGCUCAA | 20 | 2022 |
| MLH1-12 | + | GGCAGGGGUUAUUCGGCGGC | 20 | 2023 |
| MLH1-13 | + | GGCCGCGUCACUCAAUGGCG | 20 | 2024 |
| MLH1-14 | + | GGUACGGAGGGAGUCGAGCC | 20 | 2025 |
| MLH1-15 | + | GGUGAACCGCAUCGCGGCGG | 20 | 2026 |
| MLH1-16 | + | GGUUCCCUGACGUGCCAGUC | 20 | 2027 |
| MLH1-17 | − | GGUUCGUUUUUAGGAGCUCG | 20 | 2028 |
| MLH1-18 | − | GUCCGCGCCAUUGAGUGACG | 20 | 2029 |
| MLH1-19 | + | GUCGAGCCGGGCUCACUUAA | 20 | 2030 |
| MLH1-20 | + | GUGGUGAACCGCAUCGCGGC | 20 | 2031 |

Table II.69B provides exemplary targeting domains of gRNAs to be used with an eiCas9 fusion molecule (e.g., an eiCas9 fused to a transcription activator or repressor domain) to alter (e.g., activate or repress) a gene, e.g., M1H1 gene. The targeting domains of gRNAs were selected according to the second tier parameters. The targeting domains bind within 500 bp spanning a transcription start site (TSS), e.g., upstream or downstream of a TSS and have a high level of orthogonality. It is contemplated herein that in an embodiment the targeting domain hybridizes to the target domain through complementary base pairing. Any of the targeting domains in the table can be used with a S. pyogenes eiCas9 fusion molecule (e.g., an eiCas9 fused to a transcription activator or repressor domain) to alter (e.g., activate or repress) the M1H1 gene. One or more gRNA may be used to target an eiCas9 fusion molecule to a region spanning 500 bp of a transcription start site (TSS) of the M1H1 gene.

Table II.70A provides exemplary targeting domains of gRNAs to be used with an eiCas9 fusion molecule (e.g., an eiCas9 fused to a transcription activator or repressor domain) to alter (e.g., activate or repress) a gene, e.g., M1H1 gene. The targeting domains of gRNAs were selected according to the first tier parameters. The targeting domains bind within 500 bp spanning a transcription start site (TSS), e.g., upstream or downstream of a TSS, have a high level of orthogonality, start with a 5'G and PAM is NNGRRT. It is contemplated herein that in an embodiment the targeting domain hybridizes to the target domain through complementary base pairing. Any of the targeting domains in the table can be used with a S. aureus eiCas9 fusion molecule (e.g., an eiCas9 fused to a transcription activator or repressor domain) to alter (e.g., activate or repress) the M1H1 gene. One or more gRNA may be used to target an eiCas9 fusion molecule to a region spanning 500 bp of a transcription start site (TSS) of the M1H1 gene.

TABLE II.69B

Exemplary HDR-enhancing gRNAs Targeting a M1H1 Gene

S. pyogenes — A high level of orthogonality 69B

| 2nd Tier gRNA Name | DNA Strand | Targeting Domain | Target Site Length | Seq ID |
|---|---|---|---|---|
| MLH1-21 | + | ACAGCGCAUGCCCACAACGG | 20 | 2032 |
| MLH1-22 | + | ACUUAAGGGCUACGACUUAA | 20 | 2033 |
| MLH1-23 | + | AGUCGAGCCGGGCUCACUUA | 20 | 2034 |
| MLH1-24 | + | AGUGGUGAACCGCAUCGCGG | 20 | 2035 |
| MLH1-25 | + | AUGGCGUAAGCUACAGCUGA | 20 | 2036 |
| MLH1-26 | + | CCACAACGGCGGAGGCCGCC | 20 | 2037 |
| MLH1-27 | + | CCCACAACGGCGGAGGCCGC | 20 | 2038 |
| MLH1-28 | − | CCGGCGGCCUCCGCCGUUGU | 20 | 2039 |
| MLH1-29 | + | CGCAUAUCCUUCUAGGUAGC | 20 | 2040 |
| MLH1-30 | + | CGCGGACACGCCUCUUUGCC | 20 | 2041 |
| MLH1-31 | + | CGGCGGGGGAAGUUAUCCAG | 20 | 2042 |
| MLH1-32 | + | CGUUCGUGGCAGGGGUUAUU | 20 | 2043 |
| MLH1-33 | + | CUUAAGGGCUACGACUUAAC | 20 | 2044 |
| MLH1-34 | + | UAACGGGCCGCGUCACUCAA | 20 | 2045 |
| MLH1-35 | − | UAACUUCCCCGCCGCGAUG | 20 | 2046 |
| MLH1-36 | + | UAGCGGGCAGUAGCCGCUUC | 20 | 2047 |
| MLH1-37 | + | UCGUGGCAGGGGUUAUUCGG | 20 | 2048 |
| MLH1-38 | − | UGAUAGCAUUAGCUGGCCGC | 20 | 2049 |
| MLH1-39 | + | UGGCGCCAAAAUGUCGUUCG | 20 | 2050 |
| MLH1-40 | + | UGGUGAACCGCAUCGCGGCG | 20 | 2051 |

TABLE II.70A

Exemplary HDR-enhancing gRNAs Targeting a MlH1 Gene

S. aureus — A high level of orthogonality, starts with a G, PAM is NNGRRT
70A

| 1st Tier gRNA Name | DNA Strand | Targeting Domain | Target Site Length | Seq ID |
|---|---|---|---|---|
| MLH1-41 | + | GACGAAGAGACCCAGCAACCCA | 22 | 2052 |
| MLH1-42 | + | GAUGAUUGAGAACUGGUACGGA | 22 | 2053 |
| MLH1-43 | − | GCAAAGAGGCGUGUCCGCGCCA | 22 | 2054 |
| MLH1-44 | − | GCCAGUCAAAUUUCUCAACUCU | 22 | 2055 |
| MLH1-45 | + | GCGCCAAAAUGUCGUUCGUGGC | 22 | 2056 |
| MLH1-46 | − | GCGGCUACUGCCCGCUACCUAG | 22 | 2057 |
| MLH1-47 | + | GGGUUGUUUGGAGUGUAAGUGG | 22 | 2058 |
| MLH1-48 | + | GUCCAAUCAAUAGCUGCCGCUG | 22 | 2059 |

Table II.70B provides exemplary targeting domains of gRNAs to be used with an eiCas9 fusion molecule (e.g., an eiCas9 fused to a transcription activator or repressor domain) to alter (e.g., activate or repress) a gene, e.g., M1H1 gene. The targeting domains of gRNAs were selected according to the second tier parameters. The targeting domains bind within 500 bp spanning a transcription start site (TSS), e.g., upstream or downstream of a TSS, have a high level of orthogonality and PAM is NNGRRT. It is contemplated herein that in an embodiment the targeting domain hybridizes to the target domain through complementary base pairing. Any of the targeting domains in the table can be used with a S. aureus eiCas9 fusion molecule (e.g., an eiCas9 fused to a transcription activator or repressor domain) to alter (e.g., activate or repress) the M1H1 gene. One or more gRNA may be used to target an eiCas9 fusion molecule to a region spanning 500 bp of a transcription start site (TSS) of the M1H1 gene.

Table II.71A provides exemplary targeting domains of gRNAs to be used with an eiCas9 fusion molecule (e.g., an eiCas9 fused to a transcription activator or repressor domain) to alter (e.g., activate or repress) a gene, e.g., PMS2 gene. The targeting domains of gRNAs were selected according to the first tier parameters. The targeting domains bind within 500 bp spanning a transcription start site (TSS), e.g., upstream or downstream of a TSS, have a high level of orthogonality and start with a 5'G. It is contemplated herein that in an embodiment the targeting domain hybridizes to the target domain through complementary base pairing. Any of the targeting domains in the table can be used with a S. pyogenes eiCas9 fusion molecule (e.g., an eiCas9 fused to a transcription activator or repressor domain) to alter (e.g., activate or repress) the PMS2 gene. One or more gRNA may be used to target an eiCas9 fusion molecule to a region spanning 500 bp of a transcription start site (TSS) of the PMS2 gene.

TABLE II.70B

Exemplary HDR-enhancing gRNAs Targeting a MlH1 Gene

S. aureus — A high level of orthogonality, and PAM is NNGRRT
70B

| 2nd Tier gRNA Name | DNA Strand | Targeting Domain | Target Site Length | Seq ID |
|---|---|---|---|---|
| MLH1-49 | − | AAUUUCUCAACUCUGUGGGUUG | 22 | 2060 |
| MLH1-50 | + | AUGCCCACAACGGCGGAGGCCG | 22 | 2061 |
| MLH1-51 | + | CCGAGACCUUUUAAGGGUUGUU | 22 | 2062 |
| MLH1-52 | + | CCGCUCUCCCCCGAGACCUUUU | 22 | 2063 |
| MLH1-53 | − | CGGCAGCUAUUGAUUGGACAGC | 22 | 2064 |
| MLH1-54 | − | CUUUGAUAGCAUUAGCUGGCCG | 22 | 2065 |
| MLH1-55 | + | UAGCUGCCGCUGAAGGGUGGGG | 22 | 2066 |
| MLH1-56 | − | UCACCACUGUCUCGUCCAGCCG | 22 | 2067 |
| MLH1-57 | − | UUGGUUCGUUUUUAGGAGCUCG | 22 | 2068 |

TABLE II.71A

Exemplary HDR-enhancing gRNAs Targeting a PMS2 Gene

| S. pyogenes | | A high level of orthogonality, and starts with a G 71A | | |
|---|---|---|---|---|
| 1st Tier gRNA Name | DNA Strand | Targeting Domain | Target Site Length | Seq ID |
| PMS2-1 | + | GACAGAGCCAAUAGGCGAAA | 20 | 2069 |
| PMS2-2 | - | GACUGGGAAAGUUCCCUCCA | 20 | 2070 |
| PMS2-3 | - | GCAACACCCGAUCCGCCUCG | 20 | 2071 |
| PMS2-4 | + | GCAGCCAAUGGGAGUUCAGG | 20 | 2072 |
| PMS2-5 | + | GCCAAUGGGAGUUCAGGAGG | 20 | 2073 |
| PMS2-6 | + | GCCGCCCCGCCCGGAAAGGG | 20 | 2074 |
| PMS2-7 | + | GCGCCUGUGGGAGCCCUGGA | 20 | 2075 |
| PMS2-8 | - | GGACUGGGAAAGUUCCCUCC | 20 | 2076 |
| PMS2-9 | + | GGGAACUUUCCCAGUCCCCG | 20 | 2077 |
| PMS2-10 | - | GUGCUCCACCCUUUCCGGGC | 20 | 2078 |
| PMS2-11 | - | GUUCCCUCCAGGGCUCCCAC | 20 | 2079 |

Table II.71B provides exemplary targeting domains of gRNAs to be used with an eiCas9 fusion molecule (e.g., an eiCas9 fused to a transcription activator or repressor domain) to alter (e.g., activate or repress) a gene, e.g., PMS2 gene. The targeting domains of gRNAs were selected according to the second tier parameters. The targeting domains bind within 500 bp spanning a transcription start site (TSS), e.g., upstream or downstream of a TSS and have a high level of orthogonality. It is contemplated herein that in an embodiment the targeting domain hybridizes to the target domain through complementary base pairing. Any of the targeting domains in the table can be used with a S. pyogenes eiCas9 fusion molecule (e.g., an eiCas9 fused to a transcription activator or repressor domain) to alter (e.g., activate or repress) the PMS2 gene. One or more gRNA may be used to target an eiCas9 fusion molecule to a region spanning 500 bp of a transcription start site (TSS) of the PMS2 gene.

TABLE II.71B

Exemplary HDR-enhancing gRNAs Targeting a PMS2 Gene

| S. pyogenes | | A high level of orthogonality 71B | | |
|---|---|---|---|---|
| 2nd Tier gRNA Name | DNA Strand | Targeting Domain | Target Site Length | Seq ID |
| PMS2-12 | + | AAAGCAGCCAAUGGGAGUUC | 20 | 2080 |
| PMS2-13 | - | ACCCGAUCCGCCUCGGGGAC | 20 | 2081 |
| PMS2-14 | + | AGCGCCUGUGGGAGCCCUGG | 20 | 2082 |
| PMS2-15 | + | AGUAUUUUUGCCGCCCCGCC | 20 | 2083 |
| PMS2-16 | - | AUGCAACACCCGAUCCGCCU | 20 | 2084 |
| PMS2-17 | - | CCCGAUCCGCCUCGGGGACU | 20 | 2085 |
| PMS2-18 | + | CGACCUUUGACAGAGCCAAU | 20 | 2086 |
| PMS2-19 | + | CGGAGCGCCUGUGGGAGCCC | 20 | 2087 |
| PMS2-20 | + | CGGAUCGGGUGUUGCAUCCA | 20 | 2088 |
| PMS2-21 | + | CGGUGUGCUCUGAUUGGCCC | 20 | 2089 |
| PMS2-22 | - | CUUCGUGACGUCAAAGAGCC | 20 | 2090 |
| PMS2-23 | + | UCAGGAGGCGGAGCGCCUGU | 20 | 2091 |

TABLE II.71B-continued

Exemplary HDR-enhancing gRNAs Targeting a PMS2 Gene

S. pyogenes — A high level of orthogonality 71B

| 2nd Tier gRNA Name | DNA Strand | Targeting Domain | Target Site Length | Seq ID |
|---|---|---|---|---|
| PMS2-24 | + | UCCCAGUCCCCGAGGCGGAU | 20 | 2092 |
| PMS2-25 | − | UCCGCCUCCUGAACUCCCAU | 20 | 2093 |
| PMS2-26 | − | UCGCCUAUUGGCUCUGUCAA | 20 | 2094 |
| PMS2-27 | − | UGCAACACCCGAUCCGCCUC | 20 | 2095 |
| PMS2-28 | + | UUCAGGAGGCGGAGCGCCUG | 20 | 2096 |
| PMS2-29 | − | UUCGUGACGUCAAAGAGCCU | 20 | 2097 |
| PMS2-30 | + | UUUGCCGCCCCGCCCGGAAA | 20 | 2098 |
| PMS2-31 | + | UUUUGCCGCCCCGCCCGGAA | 20 | 2099 |

Table II.72A provides exemplary targeting domains of gRNAs to be used with an eiCas9 fusion molecule (e.g., an eiCas9 fused to a transcription activator or repressor domain) to alter (e.g., activate or repress) a gene, e.g., PMS2 gene. The targeting domains of gRNAs were selected according to the first tier parameters. The targeting domains bind within 500 bp spanning a transcription start site (TSS), e.g., upstream or downstream of a TSS, have a high level of orthogonality, start with a 5'G and PAM is NNGRRT. It is contemplated herein that in an embodiment the targeting domain hybridizes to the target domain through complementary base pairing. Any of the targeting domains in the table can be used with a S. aureus eiCas9 fusion molecule (e.g., an eiCas9 fused to a transcription activator or repressor domain) to alter (e.g., activate or repress) the PMS2 gene. One or more gRNA may be used to target an eiCas9 fusion molecule to a region spanning 500 bp of a transcription start site (TSS) of the PMS2 gene.

TABLE II.72A

Exemplary HDR-enhancing gRNA Targeting a PMS2 Gene

S. aureus — A high level of orthogonality, starts with a G, PAM is NNGRRT 72A

| 1st Tier gRNA Name | DNA Strand | Targeting Domain | Target Site Length | Seq ID |
|---|---|---|---|---|
| PMS2-32 | + | GGGAACUUUCCCAGUCCCCGAG | 22 | 2100 |

Table II.72B provides exemplary targeting domains of gRNAs to be used with an eiCas9 fusion molecule (e.g., an eiCas9 fused to a transcription activator or repressor domain) to alter (e.g., activate or repress) a gene, e.g., PMS2 gene. The targeting domains of gRNAs were selected according to the second tier parameters. The targeting domains bind within 500 bp spanning a transcription start site (TSS), e.g., upstream or downstream of a TSS, have a high level of orthogonality and PAM is NNGRRT. It is contemplated herein that in an embodiment the targeting domain hybridizes to the target domain through complementary base pairing. Any of the targeting domains in the table can be used with a S. aureus eiCas9 fusion molecule (e.g., an eiCas9 fused to a transcription activator or repressor domain) to alter (e.g., activate or repress) the PMS2 gene. One or more gRNA may be used to target an eiCas9 fusion molecule to a region spanning 500 bp of a transcription start site (TSS) of the PMS2 gene.

TABLE II.72B

Exemplary HDR-enhancing gRNAs Targeting a PMS2 Gene

S. aureus — A high level of orthogonality, and PAM is NNGRRT 72B

| 2nd Tier gRNA Name | DNA Strand | Targeting Domain | Target Site Length | Seq ID |
|---|---|---|---|---|
| PMS2-33 | + | CACAACGUCGAAAGCAGCCAAU | 22 | 2101 |
| PMS2-34 | + | CUUUCCCAGUCCCCGAGGCGGA | 22 | 2102 |
| PMS2-35 | + | UAUUUUUGCCGCCCCGCCCGGA | 22 | 2103 |

Table II.73A provides exemplary targeting domains of gRNAs to be used with an eiCas9 fusion molecule (e.g., an eiCas9 fused to a transcription activator or repressor domain) to alter (e.g., activate or repress) a gene, e.g., EZH2 gene. The targeting domains of gRNAs were selected according to the first tier parameters. The targeting domains bind within 500 bp spanning a transcription start site (TSS), e.g., upstream or downstream of a TSS, have a high level of orthogonality and start with a 5'G. It is contemplated herein that in an embodiment the targeting domain hybridizes to the target domain through complementary base pairing. Any of the targeting domains in the table can be used with a S. pyogenes eiCas9 fusion molecule (e.g., an eiCas9 fused to a transcription activator or repressor domain) to alter (e.g., activate or repress) the EZH2 gene. One or more gRNA may be used to target an eiCas9 fusion molecule to a region spanning 500 bp of a transcription start site (TSS) of the EZH2 gene.

TABLE II.73A

Exemplary HDR-enhancing gRNAs Targeting a EZH2 Gene

S. pyogenes — A high level of orthogonality, and starts with a G — 73A

| 1st Tier gRNA Name | DNA Strand | Targeting Domain | Target Site Length | Seq ID |
|---|---|---|---|---|
| EZH2-1 | + | GAACAACGCGAGUCGGCGCG | 20 | 2104 |
| EZH2-2 | + | GACACCCGGUGGGACUCAGA | 20 | 2105 |
| EZH2-3 | + | GAGUGCGAACCGGGCGGCGG | 20 | 2106 |
| EZH2-4 | + | GCCACUGCUGUGCCGGUCCC | 20 | 2107 |
| EZH2-5 | − | GCCCCGAUUGGCGGGACGCG | 20 | 2108 |
| EZH2-6 | + | GCCGCGUUUGGCGCUCGGUC | 20 | 2109 |
| EZH2-7 | + | GCCUCGCGUCCCGCCAAUCG | 20 | 2110 |
| EZH2-8 | + | GCGGCGCUUGAUUGGGCUGG | 20 | 2111 |
| EZH2-9 | − | GCGGGCGCCCGUCCAAUCAC | 20 | 2112 |
| EZH2-10 | − | GGACCGGCACAGCAGUGGCG | 20 | 2113 |
| EZH2-11 | + | GGCGAUUGGGCUGCCGCGUU | 20 | 2114 |
| EZH2-12 | + | GGCGGCGCUUGAUUGGGCUG | 20 | 2115 |
| EZH2-13 | + | GGGCGGCGCUUGAUUGGGCU | 20 | 2116 |
| EZH2-14 | + | GGGCUCCGGGAGUGCGAACC | 20 | 2117 |
| EZH2-15 | + | GGGCUGCCGCGUUUGGCGCU | 20 | 2118 |
| EZH2-16 | + | GGGGCGGCGCUUGAUUGGGC | 20 | 2119 |
| EZH2-17 | + | GGGGCUCCGGGAGUGCGAAC | 20 | 2120 |
| EZH2-18 | + | GGGGGGCCAAAUAAAAGCGA | 20 | 2121 |
| EZH2-19 | + | GGUCGCGUCCGACACCCGGU | 20 | 2122 |
| EZH2-20 | + | GUCCGGUCGCGUCCGACACC | 20 | 2123 |

Table II.73B provides exemplary targeting domains of gRNAs to be used with an eiCas9 fusion molecule (e.g., an eiCas9 fused to a transcription activator or repressor domain) to alter (e.g., activate or repress) a gene, e.g., EZH2 gene. The targeting domains of gRNAs were selected according to the second tier parameters. The targeting domains bind within 500 bp spanning a transcription start site (TSS), e.g., upstream or downstream of a TSS and have a high level of orthogonality. It is contemplated herein that in an embodiment the targeting domain hybridizes to the target domain through complementary base pairing. Any of the targeting domains in the table can be used with a S. pyogenes eiCas9 fusion molecule (e.g., an eiCas9 fused to a transcription activator or repressor domain) to alter (e.g., activate or repress) the EZH2 gene. One or more gRNA may be used to target an eiCas9 fusion molecule to a region spanning 500 bp of a transcription start site (TSS) of the EZH2 gene.

TABLE II.73B

Exemplary HDR-enhancing gRNAs Targeting a EZH2 Gene

S. pyogenes — A high level of orthogonality — 73B

| 2nd Tier gRNA Name | DNA Strand | Targeting Domain | Target Site Length | Seq ID |
|---|---|---|---|---|
| EZH2-21 | + | AACAACGCGAGUCGGCGCGC | 20 | 2124 |
| EZH2-22 | + | AAUCGGGGCGGCGCUUGAUU | 20 | 2125 |
| EZH2-23 | − | ACCGGACCGAGCGCCAAACG | 20 | 2126 |
| EZH2-24 | + | ACGAAGGUAACGCGCCGCUG | 20 | 2127 |

TABLE II.73B-continued

Exemplary HDR-enhancing gRNAs Targeting a EZH2 Gene

S. pyogenes — A high level of orthogonality 73B

| 2nd Tier gRNA Name | DNA Strand | Targeting Domain | Target Site Length | Seq ID |
|---|---|---|---|---|
| EZH2-25 | + | AGGUAACGCGCCGCUGCGGG | 20 | 2128 |
| EZH2-26 | − | CAAGCGCCGCCCCGAUUGGC | 20 | 2129 |
| EZH2-27 | − | CAAUCAAGCGCCGCCCCGAU | 20 | 2130 |
| EZH2-28 | − | CAAUCGCCAUCGCUUUUAUU | 20 | 2131 |
| EZH2-29 | + | CAAUCGGGCGGCGCUUGAU | 20 | 2132 |
| EZH2-30 | − | CACCGGGUGUCGGACGCGAC | 20 | 2133 |
| EZH2-31 | − | CCGAUUGGCGGGACGCGAGG | 20 | 2134 |
| EZH2-32 | + | CCGCCUCGCGUCCCGCCAAU | 20 | 2135 |
| EZH2-33 | + | CGAGUCGGCGCGCGGGACGA | 20 | 2136 |
| EZH2-34 | − | CGAUUGGCGGGACGCGAGGC | 20 | 2137 |
| EZH2-35 | − | CGCCGCCCGGUUCGCACUCC | 20 | 2138 |
| EZH2-36 | + | CGCCUCGCGUCCCGCCAAUC | 20 | 2139 |
| EZH2-37 | + | CGCGCGGGAACAACGCGAGU | 20 | 2140 |
| EZH2-38 | + | CGGUCGCGUCCGACACCCGG | 20 | 2141 |
| EZH2-39 | − | UCAAGCGCCGCCCCGAUUGG | 20 | 2142 |
| EZH2-40 | + | UCGCGUCCCGCCAAUCGGGG | 20 | 2143 |

Table II.74A provides exemplary targeting domains of gRNAs to be used with an eiCas9 fusion molecule (e.g., an eiCas9 fused to a transcription activator or repressor domain) to alter (e.g., activate or repress) a gene, e.g., EZH2 gene. The targeting domains of gRNAs were selected according to the first tier parameters. The targeting domains bind within 500 bp spanning a transcription start site (TSS), e.g., upstream or downstream of a TSS, have a high level of orthogonality, start with a 5'G and PAM is NNGRRT. It is contemplated herein that in an embodiment the targeting domain hybridizes to the target domain through complementary base pairing. Any of the targeting domains in the table can be used with a S. aureus eiCas9 fusion molecule (e.g., an eiCas9 fused to a transcription activator or repressor domain) to alter (e.g., activate or repress) the EZH2 gene. One or more gRNA may be used to target an eiCas9 fusion molecule to a region spanning 500 bp of a transcription start site (TSS) of the EZH2 gene.

TABLE II.74A

Exemplary HDR-enhancing gRNAs Targeting a EZH2 Gene

S. aureus — A high level of orthogonality, starts with a G, PAM is NNGRRT 74A

| 1st Tier gRNA Name | DNA Strand | Targeting Domain | Target Site Length | Seq ID |
|---|---|---|---|---|
| EZH2-41 | − | GCCGCCGGGGCUCCACUGCCUU | 22 | 2144 |
| EZH2-42 | + | GCGGCCCGGCCGGCGGGGCUCC | 22 | 2145 |
| EZH2-43 | + | GGGGGCGACGCGCGGGAACAAC | 22 | 2146 |

Table II.74B provides exemplary targeting domains of gRNAs to be used with an eiCas9 fusion molecule (e.g., an eiCas9 fused to a transcription activator or repressor domain) to alter (e.g., activate or repress) a gene, e.g., EZH2 gene. The targeting domains of gRNAs were selected according to the second tier parameters. The targeting domains bind within 500 bp spanning a transcription start site (TSS), e.g., upstream or downstream of a TSS, have a high level of orthogonality and PAM is NNGRRT. It is contemplated herein that in an embodiment the targeting-domain hybridizes to the target domain through complementary base pairing. Any of the targeting domains in the table can be used with a *S. aureus* eiCas9 fusion molecule (e.g., an eiCas9 fused to a transcription activator or repressor domain) to alter (e.g., activate or repress) the EZH2 gene. One or more gRNA may be used to target an eiCas9 fusion molecule to a region spanning 500 bp of a transcription start site (TSS) of the EZH2 gene.

TABLE II.74B

Exemplary HDR-enhancing gRNAs Targeting a EZH2 Gene

| S. aureus | A high level of orthogonality, and PAM is NNGRRT 74B | | | |
|---|---|---|---|---|
| 2nd Tier gRNA Name | DNA Strand | Targeting Domain | Target Site Length | Seq ID |
| EZH2-44 | + | CCCCGCCACUGCUGUGCCGGUC | 22 | 2147 |
| EZH2-45 | − | CUCCACUGCCUUCUGAGUCCCA | 22 | 2148 |

Table II.75A provides exemplary targeting domains of gRNAs to be used with an eiCas9 fusion molecule (e.g., an eiCas9 fused to a transcription activator or repressor domain) to alter (e.g., activate or repress) a gene, e.g., KDM4A (also referred to JMJD2A) gene. The targeting domains of gRNAs were selected according to the first tier parameters. The targeting domains bind within 500 bp spanning a transcription start site (TSS), e.g., upstream or downstream of a TSS, have a high level of orthogonality and start with a 5'G. It is contemplated herein that in an embodiment the targeting domain hybridizes to the target domain through complementary base pairing. Any of the targeting domains in the table can be used with a *S. pyogenes* eiCas9 fusion molecule (e.g., an eiCas9 fused to a transcription activator or repressor domain) to alter (e.g., activate or repress) the KDM4A (also referred to JMJD2A) gene. One or more gRNA may be used to target an eiCas9 fusion molecule to a region spanning 500 bp of a transcription start site (TSS) of the KDM4A (also referred to JMJD2A) gene.

TABLE II.75A

Exemplary HDR-enhancing gRNAs Targeting a KDM4A Gene

| S. pyogenes | A high level of orthogonality, and starts with a G 75A | | | |
|---|---|---|---|---|
| 1st Tier gRNA Name | DNA Strand | Targeting Domain | Target Site Length | Seq ID |
| KDM4A-1 | + | GAGCUGAGCCUAAGCCCUGG | 20 | 2149 |
| KDM4A-2 | + | GAGUUUCGGCCUUCGCCUGC | 20 | 2150 |
| KDM4A-3 | − | GAUCCUACUGCUUUUCCAGC | 20 | 2151 |
| KDM4A-4 | + | GAUCGGCCAGUGGCGACAGC | 20 | 2152 |
| KDM4A-5 | + | GAUGCCGACUUUAGAGGAGG | 20 | 2153 |
| KDM4A-6 | + | GCAGAUGCCGACUUUAGAGG | 20 | 2154 |
| KDM4A-7 | + | GCUGAGCCUAAGCCCUGGCG | 20 | 2155 |
| KDM4A-8 | + | GCUUGCAGCCACCCUUGAAU | 20 | 2156 |
| KDM4A-9 | + | GGCUGUAGGUGAGAACUAUA | 20 | 2157 |
| KDM4A-10 | + | GGGCUGUAGGUGAGAACUAU | 20 | 2158 |
| KDM4A-11 | − | GUACAGAGUCAACCAAUUCA | 20 | 2159 |

Table II.75B provides exemplary targeting domains of gRNAs to be used with an eiCas9 fusion molecule (e.g., an eiCas9 fused to a transcription activator or repressor domain) to alter (e.g., activate or repress) a gene, e.g., KDM4A (also referred to JMJD2A) gene. The targeting domains of gRNAs were selected according to the second tier parameters. The targeting domains bind within 500 bp spanning a transcription start site (TSS), e.g., upstream or downstream of a TSS and have a high level of orthogonality. It is contemplated herein that in an embodiment the targeting domain hybridizes to the target domain through complementary base pairing. Any of the targeting domains in the table can be used with a *S. pyogenes* eiCas9 fusion molecule (e.g., an eiCas9 fused to a transcription activator or repressor domain) to alter (e.g., activate or repress) the KDM4A (also referred to JMJD2A) gene. One or more gRNA may be used to target an eiCas9 fusion molecule to a region spanning 500 bp of a transcription start site (TSS) of the KDM4A (also referred to JMJD2A) gene.

TABLE II.75B

Exemplary HDR-enhancing gRNAs Targeting a KDM4A Gene

| S. pyogenes | A high level of orthogonality 75B | | | |
|---|---|---|---|---|
| 2nd Tier gRNA Name | DNA Strand | Targeting Domain | Target Site Length | Seq ID |
| KDM4A-12 | + | AAAGCAGUAGGAUCGGCCAG | 20 | 2160 |
| KDM4A-13 | − | AACUCCGCCUCCUCUAAAGU | 20 | 2161 |
| KDM4A-14 | − | ACUGCUUUUCCAGCAGGCGA | 20 | 2162 |
| KDM4A-15 | − | AGAGUCAACCAAUUCAAGGG | 20 | 2163 |
| KDM4A-16 | + | AGCUGAGCCUAAGCCCUGGC | 20 | 2164 |
| KDM4A-17 | − | CCAAAGCCCCGCCAGGGCUU | 20 | 2165 |
| KDM4A-18 | + | CCUAAGCCCUGGCGGGGCUU | 20 | 2166 |
| KDM4A-19 | + | CGUGCUCAUUGGCUGGUGUA | 20 | 2167 |
| KDM4A-20 | + | CUAAGCCCUGGCGGGGCUUU | 20 | 2168 |
| KDM4A-21 | − | CUACAGCCCAAAGCCCCGCC | 20 | 2169 |
| KDM4A-22 | + | CUGGCGGGGCUUUGGGCUGU | 20 | 2170 |
| KDM4A-23 | + | CUUUAGAGGAGGCGGAGUUU | 20 | 2171 |
| KDM4A-24 | − | UACAGAGUCAACCAAUUCAA | 20 | 2172 |
| KDM4A-25 | − | UACAGCCCAAAGCCCCGCCA | 20 | 2173 |
| KDM4A-26 | − | UCAGCUCCUGCUGUCGCCAC | 20 | 2174 |
| KDM4A-27 | + | UCGCCUGCUGGAAAAGCAGU | 20 | 2175 |
| KDM4A-28 | + | UGCGCAGAUGCCGACUUUAG | 20 | 2176 |
| KDM4A-29 | + | UGCGGCGCGUGCUCAUUGGC | 20 | 2177 |
| KDM4A-30 | + | UGCUGGAAAAGCAGUAGGAU | 20 | 2178 |
| KDM4A-31 | + | UGGCUGCGGCGCGUGCUCAU | 20 | 2179 |

Table II.76A provides exemplary targeting domains of gRNAs to be used with an eiCas9 fusion molecule (e.g., an eiCas9 fused to a transcription activator or repressor domain) to alter (e.g., activate or repress) a gene, e.g., KDM4A (also referred to JMJD2A) gene. The targeting domains of gRNAs were selected according to the first tier parameters. The targeting domains bind within 500 bp spanning a transcription start site (TSS), e.g., upstream or downstream of a TSS, have a high level of orthogonality, start with a 5'G and PAM is NNGRRT. It is contemplated herein that in an embodiment the targeting domain hybridizes to the target domain through complementary base pairing. Any of the targeting domains in the table can be used with a *S. aureus* eiCas9 fusion molecule (e.g., an eiCas9 fused to a transcription activator or repressor domain) to alter (e.g., activate or repress) the KDM4A (also referred to JMJD2A) gene. One or more gRNA may be used to target an eiCas9 fusion molecule to a region spanning 500 bp of a transcription start site (TSS) of the KDM4A (also referred to JMJD2A) gene.

TABLE II.76A

Exemplary HDR-enhancing gRNAs Targeting a KDM4A Gene

| S. aureus | | A high level of orthogonality, starts with a G, PAM is NNGRRT 76A | | |
|---|---|---|---|---|
| 1st Tier gRNA Name | DNA Strand | Targeting Domain | Target Site Length | Seq ID |
| KDM4A-32 | - | GCCGUACAGAGUCAACCAAUUC | 22 | 2180 |
| KDM4A-33 | + | GGUGUAUGGCUUGCAGCCACCC | 22 | 2181 |

Table II.76B provides exemplary targeting domains of gRNAs to be used with an eiCas9 fusion molecule (e.g., an eiCas9 fused to a transcription activator or repressor domain) to alter (e.g., activate or repress) a gene, e.g., KDM4A (also referred to JMJD2A) gene. The targeting domains of gRNAs were selected according to the second tier parameters. The targeting domains bind within 500 bp spanning a transcription start site (TSS), e.g., upstream or downstream of a TSS, have a high level of orthogonality and PAM is NNGRRT. It is contemplated herein that in an embodiment the targeting domain hybridizes to the target domain through complementary base pairing. Any of the targeting domains in the table can be used with a *S. aureus* eiCas9 fusion molecule (e.g., an eiCas9 fused to a transcription activator or repressor domain) to alter (e.g., activate or repress) the KDM4A (also referred to JMJD2A) gene. One or more gRNA may be used to target an eiCas9 fusion molecule to a region spanning 500 bp of a transcription start site (TSS) of the KDM4A (also referred to JMJD2A) gene.

TABLE II.76B

Exemplary HDR-enhancing gRNAs Targeting a KDM4A Gene

| S. aureus | | A high level of orthogonality, and PAM is NNGRRT 76B | | |
|---|---|---|---|---|
| 2nd Tier gRNA Name | DNA Strand | Targeting Domain | Target Site Length | Seq ID |
| KDM4A-34 | - | AGUCGGCAUCUGCGCAGCCGUA | 22 | 2182 |
| KDM4A-35 | + | CAGAUGCCGACUUUAGAGGAGG | 22 | 2183 |
| KDM4A-36 | + | CCUUCGCCUGCUGGAAAAGCAG | 22 | 2184 |
| KDM4A-37 | + | UUUGGGCUGUAGGUGAGAACUA | 22 | 2185 |

Table II.77A provides exemplary targeting domains of gRNAs to be used with an eiCas9 fusion molecule (e.g., an eiCas9 fused to a transcription activator or repressor domain) to alter (e.g., activate or repress) a gene, e.g., CDK gene. The targeting domains of gRNAs were selected according to the first tier parameters. The targeting domains bind within 500 bp spanning a transcription start site (TSS), e.g., upstream or downstream of a TSS, have a high level of orthogonality and start with a 5'G. It is contemplated herein that in an embodiment the targeting domain hybridizes to the target domain through complementary base pairing. Any of the targeting domains in the table can be used with a *S. pyogenes* eiCas9 fusion molecule (e.g., an eiCas9 fused to a transcription activator or repressor domain) to alter (e.g., activate or repress) the CDK gene. One or more gRNA may be used to target an eiCas9 fusion molecule to a region spanning 500 bp of a transcription start site (TSS) of the CDK gene.

TABLE II.77A

Exemplary HDR-enhancing gRNAs Targeting a CDK Gene

| S. pyogenes | A high level of orthogonality, and starts with a G 77A | | | |
|---|---|---|---|---|
| 1st Tier gRNA Name | DNA Strand | Targeting Domain | Target Site Length | Seq ID |
| CDK1-1 | + | GAAGGCCUGCCCAGCGUAGC | 20 | 2186 |
| CDK1-2 | + | GAAUAAUAAGCCGGGUACAG | 20 | 2187 |
| CDK1-3 | + | GAAUCCGGGGCCCUUUAGCG | 20 | 2188 |
| CDK1-4 | + | GACGACACUCUCCCGACUGG | 20 | 2189 |
| CDK1-5 | − | GAGCGCGAAAGAAAGAGGAA | 20 | 2190 |
| CDK1-6 | − | GCAAGCGCUCUCCUCCAGUC | 20 | 2191 |
| CDK1-7 | + | GCCGCCGCGGAAUAAUAAGC | 20 | 2192 |
| CDK1-8 | − | GCGAAAGAAAGAGGAAAGGG | 20 | 2193 |
| CDK1-9 | − | GCGGCUAGAGAAAAAGCAGG | 20 | 2194 |
| CDK1-10 | + | GCUACCCGAUUGGUGAAUCC | 20 | 2195 |
| CDK1-11 | + | GCUGGCUCUUGGAAAUUGAG | 20 | 2196 |
| CDK1-12 | − | GCUGGGCAGGCCUUCCCGGG | 20 | 2197 |
| CDK1-13 | + | GGCUACCCGAUUGGUGAAUC | 20 | 2198 |
| CDK1-14 | − | GGCUAGAGCGCGAAAGAAAG | 20 | 2199 |
| CDK1-15 | − | GGGCCCCGGAUUCACCAAUC | 20 | 2200 |
| CDK1-16 | + | GGGGUCAGGGUCGUGUCUAG | 20 | 2201 |
| CDK1-17 | + | GGGUACAGUGGCUGGGGUCA | 20 | 2202 |
| CDK1-18 | + | GGUUGUUGUAGCUGCCGCUG | 20 | 2203 |
| CDK1-19 | − | GUACCCGGCUUAUUAUUCCG | 20 | 2204 |
| CDK1-20 | − | GUCCUACUGUUUCUAGUCAG | 20 | 2205 |

Table II.77B provides exemplary targeting domains of gRNAs to be used with an eiCas9 fusion molecule (e.g., an eiCas9 fused to a transcription activator or repressor domain) to alter (e.g., activate or repress) a gene, e.g., CDK gene. The targeting domains of gRNAs were selected according to the second tier parameters. The targeting domains bind within 500 bp spanning a transcription start site (TSS), e.g., upstream or downstream of a TSS and have a high level of orthogonality. It is contemplated herein that in an embodiment the targeting domain hybridizes to the target domain through complementary base pairing. Any of the targeting domains in the table can be used with a S. pyogenes eiCas9 fusion molecule (e.g., an eiCas9 fused to a transcription activator or repressor domain) to alter (e.g., activate or repress) the CDK gene (e.g., a CDK1 gene). One or more gRNA may be used to target an eiCas9 fusion molecule to a region spanning 500 bp of a transcription start site (TSS) of the CDK gene.

Table II.78A provides exemplary targeting domains of gRNAs to be used with an eiCas9 fusion molecule (e.g., an eiCas9 fused to a transcription activator or repressor domain) to alter (e.g., activate or repress) a gene, e.g., CDK gene. The targeting domains of gRNAs were selected according to the first tier parameters. The targeting domains bind within 500 bp spanning a transcription start site (TSS), e.g., upstream or downstream of a TSS, have a high level of orthogonality, start with a 5'G and PAM is NNGRRT. It is contemplated herein that in an embodiment the targeting domain hybridizes to the target domain through complementary base pairing. Any of the targeting domains in the table can be used with a S. aureus eiCas9 fusion molecule (e.g., an eiCas9 fused to a transcription activator or repressor domain) to alter (e.g., activate or repress) the CDK gene. One or more gRNA may be used to target an eiCas9 fusion molecule to a region spanning 500 bp of a transcription start site (TSS) of the CDK gene.

TABLE II.77B

Exemplary HDR-enhancing gRNAs Targeting a CDK Gene

S. pyogenes — A high level of orthogonality 77B

| 2nd Tier gRNA Name | DNA Strand | Targeting Domain | Target Site Length | Seq ID |
|---|---|---|---|---|
| CDK1-21 | + | AAAUUGAGCGGAGAGCGACG | 20 | 2206 |
| CDK1-22 | + | AAGUCUACGGGCUACCCGAU | 20 | 2207 |
| CDK1-23 | + | AGUUUGAAACUGCUCGCACU | 20 | 2208 |
| CDK1-24 | - | CAAUCAGAGCCCAGCUACGC | 20 | 2209 |
| CDK1-25 | - | CCCGGCUUAUUAUUCCGCGG | 20 | 2210 |
| CDK1-26 | + | CCGCCGCGGAAUAAUAAGCC | 20 | 2211 |
| CDK1-27 | - | CGCAAGCGCUCUCCUCCAGU | 20 | 2212 |
| CDK1-28 | + | CGCGCUCUAGCCACCCGGGA | 20 | 2213 |
| CDK1-29 | + | CGCUUGCGCUCGCACUCAGU | 20 | 2214 |
| CDK1-30 | + | CUACCCGAUUGGUGAAUCCG | 20 | 2215 |
| CDK1-31 | - | CUACGCUGGGCAGGCCUUCC | 20 | 2216 |
| CDK1-32 | - | CUCACCGCGCUAAAGGGCCC | 20 | 2217 |
| CDK1-33 | + | CUCCGCUGACUAGAAACAGU | 20 | 2218 |
| CDK1-34 | + | CUUUCGCGCUCUAGCCACCC | 20 | 2219 |
| CDK1-35 | + | UAGGACGACACUCUCCCGAC | 20 | 2220 |
| CDK1-36 | + | UCUUUCGCGCUCUAGCCACC | 20 | 2221 |
| CDK1-37 | + | UGGGGUCAGGGUCGUGUCUA | 20 | 2222 |
| CDK1-38 | - | UUAUUCCGCGGCGGCCGCAG | 20 | 2223 |
| CDK1-39 | - | UUCAAACUCACCGCGCUAAA | 20 | 2224 |
| CDK1-40 | - | UUUCAAACUCACCGCGCUAA | 20 | 2225 |

TABLE II.78A

Exemplary HDR-enhancing gRNAs Targeting a CDK Gene

S. aureus — A high level of orthogonality, starts with a G, PAM is NNGRRT 78A

| 1st Tier gRNA Name | DNA Strand | Targeting Domain | Target Site Length | Seq ID |
|---|---|---|---|---|
| CDK1-41 | + | GAAUCCGGGGCCCUUUAGCGCG | 22 | 2226 |
| CDK1-42 | - | GCAAGCGCUCUCCUCCAGUCGG | 22 | 2227 |
| CDK1-43 | + | GCGGCCGCCGCGGAAUAAUAAG | 22 | 2228 |
| CDK1-44 | + | GUAGCUGCCGCUGCGGCCGCCG | 22 | 2229 |

Table II.78B provides exemplary targeting domains of gRNAs to be used with an eiCas9 fusion molecule (e.g., an eiCas9 fused to a transcription activator or repressor domain) to alter (e.g., activate or repress) a gene, e.g., CDK gene. The targeting domains of gRNAs were selected according to the second tier parameters. The targeting domains bind within 500 bp spanning a transcription start site (TSS), e.g., upstream or downstream of a TSS, have a high level of orthogonality and PAM is NNGRRT. It is contemplated herein that in an embodiment the targeting domain hybridizes to the target domain through complementary base pairing. Any of the targeting domains in the table can be used with a S. aureus eiCas9 fusion molecule (e.g., an eiCas9 fused to a transcription activator or repressor domain) to alter (e.g., activate or repress) the CDK gene. One or more gRNA may be used to target an eiCas9 fusion molecule to a region spanning 500 bp of a transcription start site (TSS) of the CDK gene.

TABLE II.78B

Exemplary HDR-enhancing gRNAs Targeting a CDK Gene

S. aureus — A high level of orthogonality, and PAM is NNGRRT 78B

| 2nd Tier gRNA Name | DNA Strand | Targeting Domain | Target Site Length | Seq ID |
|---|---|---|---|---|
| CDK1-45 | - | AAACUCACCGCGCUAAAGGGCC | 22 | 2230 |
| CDK1-46 | - | AAAGCAGGAGGGCGGGCGCCAA | 22 | 2231 |
| CDK1-47 | + | AAGUCUACGGGCUACCCGAUUG | 22 | 2232 |
| CDK1-48 | + | AGCCGGGUACAGUGGCUGGGGU | 22 | 2233 |
| CDK1-49 | + | AUAAUAAGCCGGGUACAGUGGC | 22 | 2234 |
| CDK1-50 | - | CAGCUACGCUGGGCAGGCCUUC | 22 | 2235 |
| CDK1-51 | - | UAAAGGGCCCCGGAUUCACCAA | 22 | 2236 |

III. Cas9 Molecules

Cas9 molecules of a variety of species can be used in the methods and compositions described herein. While the S. pyogenes, S. aureus, and S. thermophilus Cas9 molecules are the subject of much of the disclosure herein, Cas9 molecules, derived from, or based on the Cas9 proteins of other species listed herein can be used as well. In other words, while the much of the description herein uses S. pyogenes and S. thermophilus Cas9 molecules, Cas9 molecules from the other species can replace them, e.g., Staphylococcus aureus and Neisseria meningitidis Cas9 molecules. Additional Cas9 species include: Acidovorax avenae, Actinobacillus pleuropneumoniae, Actinobacillus succinogenes, Actinobacillus suis, Actinomyces sp., Cycliphilus denitrificans, Aminomonas paucivorans, Bacillus cereus, Bacillus smithii, Bacillus thuringiensis, Bacteroides sp., Blastopirellula marina, Bradyrhizobium sp., Brevibacillus laterosporus, Campylobacter coli, Campylobacter jejuni, Campylobacter lari, Candidatus Puniceispirillum, Clostridium cellulolyticum, Clostridium perfringens, Corynebacterium accolens, Corynebacterium diphtheria, Corynebacterium matruchotii, Dinoroseobacter shibae, Eubacterium dolichum, gamma proteobacterium, Gluconacetobacter diazotrophicus, Haemophilus parainfluenzae, Haemophilus sputorum, Helicobacter canadensis, Helicobacter cinaedi, Helicobacter mustelae, Ilyobacter polytropus, Kingella kingae, Lactobacillus crispatus, Listeria ivanovii, Listeria monocytogenes, Listeriaceae bacterium, Methylocystis sp., Methylosinus trichosporium, Mobiluncus mulieris, Neisseria bacillifor-mis, Neisseria cinerea, Neisseria flavescens, Neisseria lactamica, Neisseria sp., Neisseria wadsworthii, Nitrosomonas sp., Parvibaculum lavamentivorans, Pasteurella multocida, Phascolarctobacterium succinatutens, Ralstonia syzygii, Rhodopseudomonas palustris, Rhodovulum sp., Simonsiella muelleri, Sphingomonas sp., Sporolactobacillus vineae, Staphylococcus lugdunensis, Streptococcus sp., Subdoligranulum sp., Tistrella mobilis, Treponema sp., or Verminephrobacter eiseniae.

A Cas9 molecule, or Cas9 polypeptide, as the term is used herein, refers to a molecule or a polypeptide that can interact with a guide RNA (gRNA) molecule) and, in concert with the gRNA molecule, localizes to a site which comprises a target domain, and in some embodiments, a PAM sequence. Cas9 molecule and Cas9 polypeptide, as those terms are used herein, refer to naturally occurring Cas9 molecules and to engineered, altered, or modified Cas9 molecules or Cas9 polypeptides that differ, e.g., by at least one amino acid residue, from a reference sequence, e.g., the most similar naturally occurring Cas9 molecule or a sequence of Table III.1.

Cas9 Domains

Crystal structures have been determined for two different naturally occurring bacterial Cas9 molecules (Jinek et al., SCIENCE, 343(6176): 1247997, 2014) and for *S. pyogenes* Cas9 with a guide RNA (e.g., a synthetic fusion of crRNA and tracrRNA) (Nishimasu et al., CELL, 156:935-949, 2014; and Anders et al., NATURE, 2014, doi: 10.1038/nature13579).

A naturally occurring Cas9 molecule comprises two lobes: a recognition (REC) lobe and a nuclease (NUC) lobe; each of which further comprise domains described herein. The REC lobe comprises the arginine-rich bridge helix (BH), the REC1 domain, and the REC2 domain. The REC lobe does not share structural similarity with other known proteins, indicating that it is a Cas9-specific functional domain. The BH domain is a long a helix and arginine rich region and comprises amino acids 60-93 of the sequence of *S. pyogenes* Cas9. The REC1 domain is important for recognition of the repeat:anti-repeat duplex, e.g., of a gRNA or a tracrRNA, and is therefore critical for Cas9 activity by recognizing the target sequence. The REC1 domain comprises two REC1 motifs at amino acids 94 to 179 and 308 to 717 of the sequence of *S. pyogenes* Cas9. These two REC1 domains, though separated by the REC2 domain in the linear primary structure, assemble in the tertiary structure to form the REC1 domain. The REC2 domain, or parts thereof, may also play a role in the recognition of the repeat:anti-repeat duplex. The REC2 domain comprises amino acids 180-307 of the sequence of *S. pyogenes* Cas9.

The NUC lobe comprises the RuvC domain, the HNH domain, and the PAM-interacting (PI) domain. The RuvC domain shares structural similarity to retroviral integrase superfamily members and cleaves a single strand, e.g., the non-complementary strand of the target nucleic acid molecule. The RuvC domain is assembled from the three split RuvC motifs (RuvC I, RuvCII, and RuvCIII, which are often commonly referred to in the art as RuvCI domain, or N-terminal RuvC domain, RuvCII domain, and RuvCIII domain) at amino acids 1-59, 718-769, and 909-1098, respectively, of the sequence of *S. pyogenes* Cas9. Similar to the REC1 domain, the three RuvC motifs are linearly separated by other domains in the primary structure, however in the tertiary structure, the three RuvC motifs assemble and form the RuvC domain. The HNH domain shares structural similarity with HNH endonucleases, and cleaves a single strand, e.g., the complementary strand of the target nucleic acid molecule. The HNH domain lies between the RuvC II-III motifs and comprises amino acids 775-908 of the sequence of *S. pyogenes* Cas9. The PI domain interacts with the PAM of the target nucleic acid molecule, and comprises amino acids 1099-1368 of the sequence of *S. pyogenes* Cas9.

RuvC-Like Domain and HNH-Like Domain

In an embodiment, a Cas9 molecule or Cas9 polypeptide comprises an HNH-like domain and a RuvC-like domain. In an embodiment, cleavage activity is dependent on a RuvC-like domain and an HNH-like domain. A Cas9 molecule or Cas9 polypeptide, e.g., an eaCas9 molecule or eaCas9 polypeptide, can comprise one or more of the following domains: a RuvC-like domain and an HNH-like domain. In an embodiment, a Cas9 molecule or Cas9 polypeptide is an eaCas9 molecule or eaCas9 polypeptide and the eaCas9 molecule or eaCas9 polypeptide comprises a RuvC-like domain, e.g., a RuvC-like domain described below, and/or an HNH-like domain, e.g., an HNH-like domain described below.

RuvC-Like Domains

In an embodiment, a RuvC-like domain cleaves, a single strand, e.g., the non-complementary strand of the target nucleic acid molecule. The Cas9 molecule or Cas9 polypeptide can include more than one RuvC-like domain (e.g., one, two, three or more RuvC-like domains). In an embodiment, a RuvC-like domain is at least 5, 6, 7, 8 amino acids in length but not more than 20, 19, 18, 17, 16 or 15 amino acids in length. In an embodiment, the Cas9 molecule or Cas9 polypeptide comprises an N-terminal RuvC-like domain of about 10 to 20 amino acids, e.g., about 15 amino acids in length.

N-Terminal RuvC-Like Domains

Some naturally occurring Cas9 molecules comprise more than one RuvC-like domain with cleavage being dependent on the N-terminal RuvC-like domain. Accordingly, Cas9 molecules or Cas9 polypeptide can comprise an N-terminal RuvC-like domain. Exemplary N-terminal RuvC-like domains are described below.

In an embodiment, an eaCas9 molecule or eaCas9 polypeptide comprises an N-terminal RuvC-like domain comprising an amino acid sequence of formula I:

D-X1-G-X2-X3-X4-X5-G-X6-X7-X8-X9 (SEQ ID NO: 108), wherein,

X1 is selected from I, V, M, L and T (e.g., selected from I, V, and L);

X2 is selected from T, I, V, S, N, Y, E and L (e.g., selected from T, V, and I);

X3 is selected from N, S, G, A, D, T, R, M and F (e.g., A or N);

X4 is selected from S, Y, N and F (e.g., S);

X5 is selected from V, I, L, C, T and F (e.g., selected from V, I and L);

X6 is selected from W, F, V, Y, S and L (e.g., W);

X7 is selected from A, S, C, V and G (e.g., selected from A and S);

X8 is selected from V, I, L, A, M and H (e.g., selected from V, I, M and L); and X9 is selected from any amino acid or is absent (e.g., selected from T, V, I, L, Δ, F, S, A, Y, M and R, or, e.g., selected from T, V, I, L and Δ).

In an embodiment, the N-terminal RuvC-like domain differs from a sequence of SEQ ID NO: 108, by as many as 1 but no more than 2, 3, 4, or 5 residues.

In embodiment, the N-terminal RuvC-like domain is cleavage competent.

In embodiment, the N-terminal RuvC-like domain is cleavage incompetent.

In an embodiment, a eaCas9 molecule or eaCas9 polypeptide comprises an N-terminal RuvC-like domain comprising an amino acid sequence of formula II:

D-X1-G-X2-X3-S-X5-G-X6-X7-X8-X9, (SEQ ID NO: 109), wherein

X1 is selected from I, V, M, L and T (e.g., selected from I, V, and L);

X2 is selected from T, I, V, S, N, Y, E and L (e.g., selected from T, V, and I);

X3 is selected from N, S, G, A, D, T, R, M and F (e.g., A or N);

X5 is selected from V, I, L, C, T and F (e.g., selected from V, I and L);

X6 is selected from W, F, V, Y, S and L (e.g., W);

X7 is selected from A, S, C, V and G (e.g., selected from A and S);

X8 is selected from V, I, L, A, M and H (e.g., selected from V, I, M and L); and X9 is selected from any amino acid or is absent (e.g., selected from T, V, I, L, Δ, F, S, A, Y, M and R or selected from e.g., T, V, I, L and Δ).

In an embodiment, the N-terminal RuvC-like domain differs from a sequence of SEQ ID NO: 109 by as many as 1 but no more than 2, 3, 4, or 5 residues.

In an embodiment, the N-terminal RuvC-like domain comprises an amino acid sequence of formula III:

D-I-G-X2-X3-S-V-G-W-A-X8-X9 (SEQ ID NO: 110), wherein

X2 is selected from T, I, V, S, N, Y, E and L (e.g., selected from T, V, and I);

X3 is selected from N, S, G, A, D, T, R, M and F (e.g., A or N);

X8 is selected from V, I, L, A, M and H (e.g., selected from V, I, M and L); and X9 is selected from any amino acid or is absent (e.g., selected from T, V, I, L, Δ, F, S, A, Y, M and R or selected from e.g., T, V, I, L and Δ).

In an embodiment, the N-terminal RuvC-like domain differs from a sequence of SEQ ID NO:110 by as many as 1 but no more than, 2, 3, 4, or 5 residues.

In an embodiment, the N-terminal RuvC-like domain comprises an amino acid sequence of formula III:

D-I-G-T-N-S-V-G-W-A-V-X (SEQ ID NO: 111), wherein

X is a non-polar alkyl amino acid or a hydroxyl amino acid, e.g., X is selected from V, I, L and T.

In an embodiment, the N-terminal RuvC-like domain differs from a sequence of SEQ ID NO: 111 by as many as 1 but no more than, 2, 3, 4, or 5 residues.

In an embodiment, the N-terminal RuvC-like domain differs from a sequence of an N-terminal RuvC like domain disclosed herein, as many as 1 but no more than 2, 3, 4, or 5 residues.

Additional RuvC-Like Domains

In addition to the N-terminal RuvC-like domain, the Cas9 molecule or Cas9 polypeptide, e.g., an eaCas9 molecule or eaCas9 polypeptide, can comprise one or more additional RuvC-like domains. In an embodiment, the Cas9 molecule or Cas9 polypeptide can comprise two additional RuvC-like domains. Preferably, the additional RuvC-like domain is at least 5 amino acids in length and, e.g., less than 15 amino acids in length, e.g., 5 to 10 amino acids in length, e.g., 8 amino acids in length.

An additional RuvC-like domain can comprise an amino acid sequence:

I-X1-X2-E-X3-A-R-E (SEQ ID NO: 112), wherein
X1 is V or H,
X2 is I, L or V (e.g., I or V); and
X3 is M or T.

In an embodiment, the additional RuvC-like domain comprises the amino acid sequence:

I-V-X2-E-M-A-R-E (SEQ ID NO: 113), wherein
X2 is I, L or V (e.g., I or V).

An additional RuvC-like domain can comprise an amino acid sequence:

H-H-A-X1-D-A-X2-X3 (SEQ ID NO: 114), wherein
X1 is H or L;
X2 is R or V; and
X3 is E or V.

In an embodiment, the additional RuvC-like domain comprises the amino acid sequence: H-H-A-H-D-A-Y-L (SEQ ID NO:115).

In an embodiment, the additional RuvC-like domain differs from a sequence of SEQ ID NO: 112113114115 by as many as 1 but no more than 2, 3, 4, or 5 residues.

In some embodiments, the sequence flanking the N-terminal RuvC-like domain is a sequences of formula V:

K-X1'-Y-X2'-X3'-X4'-Z-T-D-X9'-Y, (SEQ ID NO: 116).

wherein
X1' is selected from K and P,
X2' is selected from V, L, I, and F (e.g., V, I and L);
X3' is selected from G, A and S (e.g., G),
X4' is selected from L, I, V and F (e.g., L);
X9' is selected from D, E, N and Q; and
Z is an N-terminal RuvC-like domain, e.g., as described above.

HNH-Like Domains

In an embodiment, an HNH-like domain cleaves a single stranded complementary domain, e.g., a complementary strand of a double stranded nucleic acid molecule. In an embodiment, an HNH-like domain is at least 15, 20, 25 amino acids in length but not more than 40, 35 or 30 amino acids in length, e.g., 20 to 35 amino acids in length, e.g., 25 to 30 amino acids in length. Exemplary HNH-like domains are described below.

In an embodiment, an eaCas9 molecule or eaCas9 polypeptide comprises an HNH-like domain having an amino acid sequence of formula VI:

X1-X2-X3-H-X4-X5-P-X6-X7-X8-X9-X10-X11-X12-X13-X14-X15-N-X16-X17-X18-X19-X20-X21-X22-X23-N(SEQ ID NO: 117), wherein X1 is selected from D, E, Q and N (e.g., D and E);
X2 is selected from L, I, R, Q, V, M and K;
X3 is selected from D and E;
X4 is selected from I, V, T, A and L (e.g., A, I and V);
X5 is selected from V, Y, I, L, F and W (e.g., V, I and L);
X6 is selected from Q, H, R, K, Y, I, L, F and W;
X7 is selected from S, A, D, T and K (e.g., S and A);
X8 is selected from F, L, V, K, Y, M, I, R, A, E, D and Q (e.g., F);
X9 is selected from L, R, T, I, V, S, C, Y, K, F and G;
X10 is selected from K, Q, Y, T, F, L, W, M, A, E, G, and S;
X11 is selected from D, S, N, R, L and T (e.g., D);
X12 is selected from D, N and S;
X13 is selected from S, A, T, G and R (e.g., S);
X14 is selected from I, L, F, S, R, Y, Q, W, D, K and H (e.g., I, L and F);
X15 is selected from D, S, I, N, E, A, H, F, L, Q, M, G, Y and V;
X16 is selected from K, L, R, M, T and F (e.g., L, R and K);
X17 is selected from V, L, I, A and T;
X18 is selected from L, I, V and A (e.g., L and I);
X19 is selected from T, V, C, E, S and A (e.g., T and V);
X20 is selected from R, F, T, W, E, L, N, C, K, V, S, Q, I, Y, H and A;
X21 is selected from S, P, R, K, N, A, H, Q, G and L;

X22 is selected from D, G, T, N, S, K, A, I, E, L, Q, R and Y; and

X23 is selected from K, V, A, E, Y, I, C, L, S, T, G, K, M, D and F.

In an embodiment, a HNH-like domain differs from a sequence of SEQ ID NO: 117 by at least one but no more than, 2, 3, 4, or 5 residues.

In an embodiment, the HNH-like domain is cleavage competent.

In an embodiment, the HNH-like domain is cleavage incompetent.

In an embodiment, an eaCas9 molecule or eaCas9 polypeptide comprises an HNH-like domain comprising an amino acid sequence of formula VII:

X1-X2-X3-H-X4-X5-P-X6-S-X8-X9-X10-D-D-S-X14-X15-N-K-V-L-X19-X20-X21-X22-X23-N (SEQ ID NO: 118), wherein X1 is selected from D and E;
X2 is selected from L, I, R, Q, V, M and K;
X3 is selected from D and E;
X4 is selected from I, V, T, A and L (e.g., A, I and V);
X5 is selected from V, Y, I, L, F and W (e.g., V, I and L);
X6 is selected from Q, H, R, K, Y, I, L, F and W;
X8 is selected from F, L, V, K, Y, M, I, R, A, E, D and Q (e.g., F);
X9 is selected from L, R, T, I, V, S, C, Y, K, F and G;
X10 is selected from K, Q, Y, T, F, L, W, M, A, E, G, and S;
X14 is selected from I, L, F, S, R, Y, Q, W, D, K and H (e.g., I, L and F);
X15 is selected from D, S, I, N, E, A, H, F, L, Q, M, G, Y and V;
X19 is selected from T, V, C, E, S and A (e.g., T and V);
X20 is selected from R, F, T, W, E, L, N, C, K, V, S, Q, I, Y, H and A;
X21 is selected from S, P, R, K, N, A, H, Q, G and L;
X22 is selected from D, G, T, N, S, K, A, I, E, L, Q, R and Y; and
X23 is selected from K, V, A, E, Y, I, C, L, S, T, G, K, M, D and F.

In an embodiment, the HNH-like domain differs from a sequence of SEQ ID NO: 118 by 1, 2, 3, 4, or 5 residues.

In an embodiment, an eaCas9 molecule or eaCas9 polypeptide comprises an HNH-like domain comprising an amino acid sequence of formula VII:

X1-V-X3-H-I-V-P-X6-S-X8-X9-X10-D-D-S-X14-X15-N-K-V-L-T-X20-X21-X22-X23-N(SEQ ID NO: 119), wherein X1 is selected from D and E;
X3 is selected from D and E;
X6 is selected from Q, H, R, K, Y, I, L and W;
X8 is selected from F, L, V, K, Y, M, I, R, A, E, D and Q (e.g., F);
X9 is selected from L, R, T, I, V, S, C, Y, K, F and G;
X10 is selected from K, Q, Y, T, F, L, W, M, A, E, G, and S;
X14 is selected from I, L, F, S, R, Y, Q, W, D, K and H (e.g., I, L and F);
X15 is selected from D, S, I, N, E, A, H, F, L, Q, M, G, Y and V;
X20 is selected from R, F, T, W, E, L, N, C, K, V, S, Q, I, Y, H and A;
X21 is selected from S, P, R, K, N, A, H, Q, G and L;
X22 is selected from D, G, T, N, S, K, A, I, E, L, Q, R and Y; and
X23 is selected from K, V, A, E, Y, I, C, L, S, T, G, K, M, D and F.

In an embodiment, the HNH-like domain differs from a sequence of SEQ ID NO: 119 by 1, 2, 3, 4, or 5 residues.

In an embodiment, an eaCas9 molecule or eaCas9 polypeptide comprises an HNH-like domain having an amino acid sequence of formula VIII:

D-X2-D-H-I-X5-P-Q-X7-F-X9-X10-D-X12-S-I-D-N-X16-V-L-X19-X20-S-X22-X23-N(SEQ ID NO: 120), wherein X2 is selected from I and V;
X5 is selected from I and V;
X7 is selected from A and S;
X9 is selected from I and L;
X10 is selected from K and T;
X12 is selected from D and N;
X16 is selected from R, K and L; X19 is selected from T and V;
X20 is selected from S and R;
X22 is selected from K, D and A; and
X23 is selected from E, K, G and N (e.g., the eaCas9 molecule or eaCas9 polypeptide can comprise an HNH-like domain as described herein).

In an embodiment, the HNH-like domain differs from a sequence of SEQ ID NO: 120 by as many as 1 but no more than 2, 3, 4, or 5 residues.

In an embodiment, an eaCas9 molecule or eaCas9 polypeptide comprises the amino acid sequence of formula IX:

L-Y-Y-L-Q-N-G-X1'-D-M-Y-X2'-X3'-X4'-X5'-L-D-I-X6'-X7'-L-S-X8'-Y-Z-N-R-X9'-K-X10'-D-X11'-V-P (SEQ ID NO: 121), wherein X1' is selected from K and R;
X2' is selected from V and T;
X3' is selected from G and D;
X4' is selected from E, Q and D;
X5' is selected from E and D;
X6' is selected from D, N and H;
X7' is selected from Y, R and N;
X8' is selected from Q, D and N; X9' is selected from G and E;
X10' is selected from S and G;
X11' is selected from D and N; and
Z is an HNH-like domain, e.g., as described above.

In an embodiment, the eaCas9 molecule or eaCas9 polypeptide comprises an amino acid sequence that differs from a sequence of SEQ ID NO: 121 by as many as 1 but no more than 2, 3, 4, or 5 residues.

In an embodiment, the HNH-like domain differs from a sequence of an HNH-like domain disclosed herein, by as many as 1 but no more than 2, 3, 4, or 5 residues.

In an embodiment, the HNH-like domain differs from a sequence of an HNH-like domain disclosed herein, by as many as 1 but no more than 2, 3, 4, or 5 residues.

Cas9 Activities

Nuclease and Helicase Activities

In an embodiment, the Cas9 molecule or Cas9 polypeptide is capable of cleaving a target nucleic acid molecule. Typically wild type Cas9 molecules cleave both strands of a target nucleic acid molecule. Cas9 molecules and Cas9 polypeptides can be engineered to alter nuclease cleavage (or other properties), e.g., to provide a Cas9 molecule or Cas9 polypeptide which is a nickase, or which lacks the ability to cleave target nucleic acid. A Cas9 molecule or Cas9 polypeptide that is capable of cleaving a target nucleic acid molecule is referred to herein as an eaCas9 (an enzymatically active Cas9) molecule or eaCas9 polypeptide.

In an embodiment, an eaCas9 molecule or eaCas9 polypeptide comprises one or more of the following enzymatic activities:

a nickase activity, i.e., the ability to cleave a single strand, e.g., the non-complementary strand or the complementary strand, of a nucleic acid molecule;

a double stranded nuclease activity, i.e., the ability to cleave both strands of a double stranded nucleic acid and create a double strand break, which in an embodiment is the presence of two nickase activities;

an endonuclease activity;

an exonuclease activity; and a helicase activity, i.e., the ability to unwind the helical structure of a double stranded nucleic acid.

In an embodiment, an enzymatically active or an eaCas9 molecule or eaCas9 polypeptide cleaves both DNA strands and results in a double strand break. In an embodiment, an eaCas9 molecule or eaCas9 polypeptide cleaves only one strand, e.g., the strand to which the gRNA hybridizes to, or the strand complementary to the strand the gRNA hybridizes with. In an embodiment, an eaCas9 molecule or eaCas9 polypeptide comprises cleavage activity associated with an HNH domain. In an embodiment, an eaCas9 molecule or eaCas9 polypeptide comprises cleavage activity associated with a RuvC domain. In an embodiment, an eaCas9 molecule or eaCas9 polypeptide comprises cleavage activity associated with an HNH domain and cleavage activity associated with a RuvC domain. In an embodiment, an eaCas9 molecule or eaCas9 polypeptide comprises an active, or cleavage competent, HNH domain and an inactive, or cleavage incompetent, RuvC domain. In an embodiment, an eaCas9 molecule or eaCas9 polypeptide comprises an inactive, or cleavage incompetent, HNH domain and an active, or cleavage competent, RuvC domain.

Some Cas9 molecules or Cas9 polypeptides have the ability to interact with a gRNA molecule, and in conjunction with the gRNA molecule, localize to a target sequence on a target nucleic acid (the target domain), but are incapable of cleaving the target nucleic acid, or incapable of cleaving at efficient rates. Cas9 molecules having no, or no substantial, cleavage activity are referred to herein as an eiCas9 molecule or eiCas9 polypeptide. For example, an eiCas9 molecule or eiCas9 polypeptide can lack cleavage activity or have substantially less, e.g., less than 20, 10, 5, 1 or 0.1% of the cleavage activity of a reference Cas9 molecule or eiCas9 polypeptide, as measured by an assay described herein.

Targeting and PAMs

A Cas9 molecule or Cas9 polypeptide, is a polypeptide that can interact with a guide RNA (gRNA) molecule and, in concert with the gRNA molecule, localizes to a site which comprises a target domain, and in an embodiment, a PAM sequence.

In an embodiment, the ability of an eaCas9 molecule or eaCas9 polypeptide to interact with and cleave a target nucleic acid is PAM sequence dependent. A PAM sequence is a sequence in the target nucleic acid. In an embodiment, cleavage of the target nucleic acid occurs upstream from the PAM sequence. EaCas9 molecules from different bacterial species can recognize different sequence motifs (e.g., PAM sequences). In an embodiment, an eaCas9 molecule of S. pyogenes recognizes the sequence motif NGG and directs cleavage of a target nucleic acid sequence 1 to 10, e.g., 3 to 5, base pairs upstream from that sequence. See, e.g., Mali et al., SCIENCE (2013) 339(6121): 823-826. In an embodiment, an eaCas9 molecule of S. thermophilus recognizes the sequence motif NGGNG (SEQ ID NO.: 90) and/or NNAGAAW (W=A or T) (SEQ ID NO.: 122) and directs cleavage of a target nucleic acid sequence 1 to 10, e.g., 3 to 5, base pairs upstream from these sequences. See, e.g., Horvath et al., SCIENCE (2010); 327(5962):167-170, and Deveau et al., J. BACTERIOL. 2008; 190(4): 1390-1400. In an embodiment, an eaCas9 molecule of S. mutans recognizes the sequence motif NGG and/or NAAR (R=A or G) (SEQ ID NO.: 123) and directs cleavage of a target nucleic acid sequence 1 to 10, e.g., 3 to 5 base pairs, upstream from this sequence. See, e.g., Deveau et al., J BACTERIOL 2008; 190(4): 1390-1400. In an embodiment, an eaCas9 molecule of S. aureus recognizes the sequence motif NNGRR (R=A or G) (SEQ ID NO.: 93) and directs cleavage of a target nucleic acid sequence 1 to 10, e.g., 3 to 5, base pairs upstream from that sequence. In an embodiment, an eaCas9 molecule of S. aureus recognizes the sequence motif NNGRRN (R=A or G)(SEQ ID NO: 124) and directs cleavage of a target nucleic acid sequence 1 to 10, e.g., 3 to 5, base pairs upstream from that sequence. In an embodiment, an eaCas9 molecule of S. aureus recognizes the sequence motif NNGRRT (R=A or G) (SEQ ID NO: 95) and directs cleavage of a target nucleic acid sequence 1 to 10, e.g., 3 to 5, base pairs upstream from that sequence. In an embodiment, an eaCas9 molecule of S. aureus recognizes the sequence motif NNGRRV (R=A or G) (SEQ ID NO.: 125) and directs cleavage of a target nucleic acid sequence 1 to 10, e.g., 3 to 5, base pairs upstream from that sequence. In an embodiment, an eaCas9 molecule of N. meningitidis recognizes the sequence motif NNNNGATT (SEQ ID NO.: 94) or NNNGCTT (R=A or G) (SEQ ID NO: 126) and directs cleavage of a target nucleic acid sequence 1 to 10, e.g., 3 to 5, base pairs upstream from that sequence. See, e.g., Hou et al. (2013) PROC. NAT'L. ACAD. SCI. USA 110(39):15644-15649. The ability of a Cas9 molecule to recognize a PAM sequence can be determined, e.g., using a transformation assay described in Jinek et al. (2012) SCIENCE 337:816. In the aforementioned embodiments, N can be any nucleotide residue, e.g., any of A, G, C or T. In one embodiment, the PAM sequence is facing outward.

As is discussed herein, Cas9 molecules can be engineered to alter the PAM specificity of the Cas9 molecule.

Exemplary naturally occurring Cas9 molecules are described in Chylinski et al. (2013) RNA BIOLOGY 10:5, 727-737. Such Cas9 molecules include Cas9 molecules of a cluster 1 bacterial family, cluster 2 bacterial family, cluster 3 bacterial family, cluster 4 bacterial family, cluster 5 bacterial family, cluster 6 bacterial family, a cluster 7 bacterial family, a cluster 8 bacterial family, a cluster 9 bacterial family, a cluster 10 bacterial family, a cluster 11 bacterial family, a cluster 12 bacterial family, a cluster 13 bacterial family, a cluster 14 bacterial family, a cluster 15 bacterial family, a cluster 16 bacterial family, a cluster 17 bacterial family, a cluster 18 bacterial family, a cluster 19 bacterial family, a cluster 20 bacterial family, a cluster 21 bacterial family, a cluster 22 bacterial family, a cluster 23 bacterial family, a cluster 24 bacterial family, a cluster 25 bacterial family, a cluster 26 bacterial family, a cluster 27 bacterial family, a cluster 28 bacterial family, a cluster 29 bacterial family, a cluster 30 bacterial family, a cluster 31 bacterial family, a cluster 32 bacterial family, a cluster 33 bacterial family, a cluster 34 bacterial family, a cluster 35 bacterial family, a cluster 36 bacterial family, a cluster 37 bacterial family, a cluster 38 bacterial family, a cluster 39 bacterial family, a cluster 40 bacterial family, a cluster 41 bacterial family, a cluster 42 bacterial family, a cluster 43 bacterial family, a cluster 44 bacterial family, a cluster 45 bacterial family, a cluster 46 bacterial family, a cluster 47 bacterial family, a cluster 48 bacterial family, a cluster 49 bacterial family, a cluster 50 bacterial family, a cluster 51 bacterial family, a cluster 52 bacterial family, a cluster 53 bacterial family, a cluster 54 bacterial family, a cluster 55 bacterial family, a cluster 56 bacterial family, a cluster 57 bacterial family, a cluster 58 bacterial family, a cluster 59 bacterial family, a cluster 60 bacterial family, a cluster 61 bacterial family, a cluster 62 bacterial family, a cluster 63 bacterial family, a cluster 64 bacterial family, a cluster 65 bacterial family, a cluster 66 bacterial family, a cluster 67 bacterial family, a cluster 68 bacterial family, a cluster 69 bacterial family, a cluster 70 bacterial family, a cluster 71 bacterial family, a cluster 72 bacterial family, a cluster 73 bacterial family, a cluster 74 bacterial family, a cluster 75 bacterial family, a cluster 76 bacterial family, a cluster 77 bacterial family, or a cluster 78 bacterial family.

Exemplary naturally occurring Cas9 molecules include a Cas9 molecule of a cluster 1 bacterial family Examples include a Cas9 molecule of: *S. pyogenes* (e.g., strain SF370, MGAS10270, MGAS10750, MGAS2096, MGAS315, MGAS5005, MGAS6180, MGAS9429, NZ131 and SSI-1), *S. thermophilus* (e.g., strain LMD-9), *S. pseudoporcinus* (e.g., strain SPIN 20026), *S. mutans* (e.g., strain UA159, NN2025), *S. macacae* (e.g., strain NCTC11558), *S. gallolyticus* (e.g., strain UCN34, ATCC BAA-2069), *S. equines* (e.g., strain ATCC 9812, MGCS 124), *S. dysgalactiae* (e.g., strain GGS 124), *S. bovis* (e.g., strain ATCC 700338), *S. anginosus* (e.g., strain F0211), *S. agalactiae* (e.g., strain NEM316, A909), *Listeria monocytogenes* (e.g., strain F6854), *Listeria innocua* (*L. innocua*, e.g., strain Clip11262), *Enterococcus italicus* (e.g., strain DSM 15952), or *Enterococcus faecium* (e.g., strain 1,231,408). Additional exemplary Cas9 molecules are a Cas9 molecule of *Neisseria meningitidis* (Hou et al., PNAS Early Edition 2013, 1-6 and a *S. aureus* Cas9 molecule.

In an embodiment, a Cas9 molecule or Cas9 polypeptide, e.g., an eaCas9 molecule or eaCas9 polypeptide, comprises an amino acid sequence:

having 60%, 65%, 70%, 75%, 80%, 81%, 82%, 83%, 84%, 85%, 86%, 87%, 88%, 89%, 90%, 91%, 92%, 93%, 94%, 95%, 96%, 97%, 98% or 99% homology with;

differs at no more than, 2, 5, 10, 15, 20, 30, or 40% of the amino acid residues when compared with;

differs by at least 1, 2, 3, 4, 5, 6, 7, 8, 9, 10, 11, 12, 13, 14, 15, 16, 17, 18, 19, 20 amino acids, but by no more than 100, 80, 70, 60, 50, 40 or 30 amino acids from; or is identical to any Cas9 molecule sequence described herein, or a naturally occurring Cas9 molecule sequence, e.g., a Cas9 molecule from a species listed herein or described in Chylinski et al. (2013) RNA BIOLOGY 10:5, 727-737; Hou et al., PNAS Early Edition 2013, 1-6. In an embodiment, the Cas9 molecule or Cas9 polypeptide comprises one or more of the following activities: a nickase activity; a double stranded cleavage activity (e.g., an endonuclease and/or exonuclease activity); a helicase activity; or the ability, together with a gRNA molecule, to localize to a target nucleic acid.

Engineered or Altered Cas9 Molecules and Cas9 Polypeptides

Cas9 molecules and Cas9 polypeptides described herein, e.g., naturally occurring Cas9 molecules, can possess any of a number of properties, including: nuclease activity (e.g., endonuclease and/or exonuclease activity); helicase activity; the ability to associate functionally with a gRNA molecule; and the ability to target (or localize to) a site on a nucleic acid (e.g., PAM recognition and specificity). In an embodiment, a Cas9 molecule or Cas9 polypeptide can include all or a subset of these properties. In a typical embodiment, a Cas9 molecule or Cas9 polypeptide has the ability to interact with a gRNA molecule and, in concert with the gRNA molecule, localize to a site in a nucleic acid. Other activities, e.g., PAM specificity, cleavage activity, or helicase activity can vary more widely in Cas9 molecules and Cas9 polypeptides.

Cas9 molecules include engineered Cas9 molecules and engineered Cas9 polypeptides (engineered, as used in this context, means merely that the Cas9 molecule or Cas9 polypeptide differs from a reference sequences, and implies no process or origin limitation). An engineered Cas9 molecule or Cas9 polypeptide can comprise altered enzymatic properties, e.g., altered nuclease activity (as compared with a naturally occurring or other reference Cas9 molecule) or altered helicase activity. As discussed herein, an engineered Cas9 molecule or Cas9 polypeptide can have nickase activity (as opposed to double strand nuclease activity). In an embodiment an engineered Cas9 molecule or Cas9 polypeptide can have an alteration that alters its size, e.g., a deletion of amino acid sequence that reduces its size, e.g., without significant effect on one or more, or any Cas9 activity. In an embodiment, an engineered Cas9 molecule or Cas9 polypeptide can comprise an alteration that affects PAM recognition. For example, an engineered Cas9 molecule can be altered to recognize a PAM sequence other than that recognized by the endogenous wild-type PI domain. In an embodiment a Cas9 molecule or Cas9 polypeptide can differ in sequence from a naturally occurring Cas9 molecule but not have significant alteration in one or more Cas9 activities.

Cas9 molecules or Cas9 polypeptides with desired properties can be made in a number of ways, e.g., by alteration of a parental, e.g., naturally occurring Cas9 molecule or Cas9 polypeptide, to provide an altered Cas9 molecule or Cas9 polypeptide having a desired property. For example, one or more mutations or differences relative to a parental Cas9 molecule, e.g., a naturally occurring or engineered Cas9 molecule, can be introduced. Such mutations and differences comprise: substitutions (e.g., conservative substitutions or substitutions of non-essential amino acids), insertions, or deletions. In an embodiment, a Cas9 molecule or Cas9 polypeptide can comprises one or more mutations or differences, e.g., at least 1, 2, 3, 4, 5, 10, 15, 20, 30, 40 or 50 mutations but less than 200, 100, or 80 mutations relative to a reference, e.g., a parental Cas9 molecule.

In an embodiment, a mutation or mutations do not have a substantial effect on a Cas9 activity, e.g. a Cas9 activity described herein. In an embodiment, a mutation or mutations have a substantial effect on a Cas9 activity, e.g. a Cas9 activity described herein.

Non-Cleaving and Modified-Cleavage Cas9 Molecules and Cas9 Polypeptides

In an embodiment, a Cas9 molecule or Cas9 polypeptide comprises a cleavage property that differs from naturally occurring Cas9 molecules, e.g., that differs from the naturally occurring Cas9 molecule having the closest homology. For example, a Cas9 molecule or Cas9 polypeptide can differ from a naturally occurring Cas9 molecule, e.g., a Cas9 molecule of *S. pyogenes*, as follows: its ability to modulate, e.g., decreased or increased, cleavage of a double stranded nucleic acid (endonuclease and/or exonuclease activity), e.g., as compared to a naturally occurring Cas9 molecule (e.g., a Cas9 molecule of *S. pyogenes*); its ability to modulate, e.g., decreased or increased, cleavage of a single strand of a nucleic acid, e.g., a non-complementary strand of a nucleic acid molecule or a complementary strand of a nucleic acid molecule (nickase activity), e.g., as compared to a naturally occurring Cas9 molecule (e.g., a Cas9 molecule of S. pyogenes); or the ability to cleave a nucleic acid molecule, e.g., a double stranded or single stranded nucleic acid molecule, can be eliminated.

Alterations in the Ability to Cleave One or Both Strands of a Target Nucleic Acid In an embodiment, exemplary Cas9 activities comprise one or more of PAM specificity, cleavage activity, and helicase activity. A mutation(s) can be present, e.g., in: one or more RuvC domains, e.g., an N-terminal RuvC domain; an HNH domain; a region outside the RuvC domains and the HNH domain. In an embodiment, a mutation(s) is present in a RuvC domain. In an embodiment, a mutation(s) is present in an HNH domain. In an embodiment, mutations are present in both a RuvC domain and an HNH domain.

Exemplary mutations that may be made in the RuvC domain or HNH domain with reference to the S. pyogenes Cas9 sequence include: D10A, E762A, H840A, N854A, N863A and/or D986A. Exemplary mutations that may be made in the RuvC domain with reference to the S. aureus Cas9 sequence include: N580A.

In an embodiment, a Cas9 molecule is an eiCas9 molecule comprising one or more differences in a RuvC domain and/or in an HNH domain as compared to a reference Cas9 molecule, and the eiCas9 molecule does not cleave a nucleic acid, or cleaves with significantly less efficiency than does wild type, e.g., when compared with wild type in a cleavage assay, e.g., as described herein, cuts with less than 50, 25, 10, or 1% of a reference Cas9 molecule, as measured by an assay described herein.

Whether or not a particular sequence, e.g., a substitution, may affect one or more activity, such as targeting activity, cleavage activity, etc., can be evaluated or predicted, e.g., by evaluating whether the mutation is conservative. In an embodiment, a "non-essential" amino acid residue, as used in the context of a Cas9 molecule, is a residue that can be altered from the wild-type sequence of a Cas9 molecule, e.g., a naturally occurring Cas9 molecule, e.g., an eaCas9 molecule, without abolishing or more preferably, without substantially altering a Cas9 activity (e.g., cleavage activity), whereas changing an "essential" amino acid residue results in a substantial loss of activity (e.g., cleavage activity).

In an embodiment, a Cas9 molecule comprises a cleavage property that differs from naturally occurring Cas9 molecules, e.g., that differs from the naturally occurring Cas9 molecule having the closest homology. For example, a Cas9 molecule can differ from naturally occurring Cas9 molecules, e.g., a Cas9 molecule of S. aureus, S. pyogenes, or C. jejuni as follows: its ability to modulate, e.g., decreased or increased, cleavage of a double strand break (endonuclease and/or exonuclease activity), e.g., as compared to a naturally occurring Cas9 molecule (e.g., a Cas9 molecule of S. aureus, S. pyogenes, or C. jejuni); its ability to modulate, e.g., decreased or increased, cleavage of a single strand of a nucleic acid, e.g., a non-complimentary strand of a nucleic acid molecule or a complementary strand of a nucleic acid molecule (nickase activity), e.g., as compared to a naturally occurring Cas9 molecule (e.g., a Cas9 molecule of S. aureus, S. pyogenes, or C. jejuni); or the ability to cleave a nucleic acid molecule, e.g., a double stranded or single stranded nucleic acid molecule, can be eliminated.

In an embodiment, the altered Cas9 molecule is an eaCas9 molecule comprising one or more of the following activities: cleavage activity associated with a RuvC domain; cleavage activity associated with an HNH domain; cleavage activity associated with an HNH domain and cleavage activity associated with a RuvC domain.

In an embodiment, the altered Cas9 molecule is an eiCas9 molecule which does not cleave a nucleic acid molecule (either double stranded or single stranded nucleic acid molecules) or cleaves a nucleic acid molecule with significantly less efficiency, e.g., less than 20, 10, 5, 1 or 0.1% of the cleavage activity of a reference Cas9 molecule, e.g., as measured by an assay described herein. The reference Cas9 molecule can be a naturally occurring unmodified Cas9 molecule, e.g., a naturally occurring Cas9 molecule such as a Cas9 molecule of S. pyogenes, S. thermophilus, S. aureus, C. jejuni or N. meningitidis. In an embodiment, the reference Cas9 molecule is the naturally occurring Cas9 molecule having the closest sequence identity or homology. In an embodiment, the eiCas9 molecule lacks substantial cleavage activity associated with a RuvC domain and cleavage activity associated with an HNH domain.

In an embodiment, the altered Cas9 molecule or Cas9 polypeptide, e.g., an eaCas9 molecule or eaCas9 polypeptide, can be a fusion, e.g., of two of more different Cas9 molecules, e.g., of two or more naturally occurring Cas9 molecules of different species. For example, a fragment of a naturally occurring Cas9 molecule of one species can be fused to a fragment of a Cas9 molecule of a second species. As an example, a fragment of a Cas9 molecule of S. pyogenes comprising an N-terminal RuvC-like domain can be fused to a fragment of Cas9 molecule of a species other than S. pyogenes (e.g., S. thermophilus) comprising an HNH-like domain.

Cas9 Molecules with Altered PAM Recognition or No PAM Recognition

Naturally occurring Cas9 molecules can recognize specific PAM sequences, for example the PAM recognition sequences described above for, e.g., S. pyogenes, S. thermophilus, S. mutans, S. aureus and N. meningitidis.

In an embodiment, a Cas9 molecule or Cas9 polypeptide has the same PAM specificities as a naturally occurring Cas9 molecule. In an embodiment, a Cas9 molecule or Cas9 polypeptide has a PAM specificity not associated with a naturally occurring Cas9 molecule, or a PAM specificity not associated with the naturally occurring Cas9 molecule to which it has the closest sequence homology. For example, a naturally occurring Cas9 molecule can be altered, e.g., to alter PAM recognition, e.g., to alter the PAM sequence that the Cas9 molecule or Cas9 polypeptide recognizes to decrease off target sites and/or improve specificity; or eliminate a PAM recognition requirement. In an embodiment, a Cas9 molecule or Cas9 polypeptide can be altered, e.g., to increase length of PAM recognition sequence and/or improve Cas9 specificity to a high level of identity (e.g., 98%, 99% or 100% match between gRNA and a PAM sequence), e.g., to decrease off target sites and increase specificity. In an embodiment, the length of the PAM recognition sequence is at least 4, 5, 6, 7, 8, 9, 10 or 15 amino acids in length. Cas9 molecules or Cas9 polypeptides that recognize different PAM sequences and/or have reduced off-target activity can be generated using directed evolution. Exemplary methods and systems that can be used for directed evolution of Cas9 molecules are described, e.g., in Esvelt et al. (2011) NATURE 472(7344): 499-503. Candidate Cas9 molecules can be evaluated, e.g., by methods described in Section IV.

In one embodiment, the Cas9 molecule is a S. pyogenes Cas9 variant. In certain embodiments, the Cas9 variant is the EQR variant. In certain embodiments, the Cas9 variant is the VRER variant. In certain embodiments, the eiCas9 molecule is a *S. pyogenes* Cas9 variant. In certain embodiments, the Cas9 variant is the EQR variant. In certain embodiments, the Cas9 variant is the VRER variant. Cas9 variants are described, for example, in Kleinstiver et al., Nature, 523: 481-485, 2015.

In certain embodiments, a Cas9 system comprises a Cas9 molecule, e.g., a Cas9 molecule described herein, e.g., the Cas9 EQR variant or the Cas9 VRER variant.

Following identification, gRNAs can be ranked into tiers based on their distance to the target site, their orthogonality and presence of a 5' G (based on identification of close matches in the human genome containing a relevant PAM (e.g., for a *S. pyogenes* Cas9 EQR variant, the PAM may be a NGAG PAM, A NGCG PAM, a NGGG PAM, a NGTG PAM, a NGAA PAM, a NGAT PAM or a NGAC PAM).

Following identification, gRNAs can be ranked into tiers based on their distance to the target site, their orthogonality and presence of a 5' G (based on identification of close matches in the human genome containing a relevant PAM (e.g., for a *S. pyogenes* Cas9 VRER variant, the PAM may be a NGCG PAM, A NGCA PAM, a NGCT PAM, or a NGCC PAM).

In some embodiments, the Cas9 molecule is a *S. aureus* Cas9 variant. In certain embodiments, the Cas9 variant is the KKH (E782K/N968K/R1015H) variant (see Kleinstiver et al. (2015) NAT. BIOTECHNOL. doi: 10.1038/nbt.3404, the entire contents of which are expressly incorporated herein by reference). In some embodiments, the Cas9 variant is the E782K/K929R/R1015H variant (see Kleinstiver et al. (2015)). In some embodiments, the Cas9 variant is the E782K/K929R/N968K/R1015H variant (see Kleinstiver et al. (2015). In some embodiments the Cas9 variant comprises one or more mutations in one of the following residues: E782, K929, N968, R1015. In some embodiments the Cas9 variant comprises one or more of the following mutations: E782K, K929R, N968K, R1015H and R1015Q (see Kleinstiver et al. (2015)). In certain embodiments, a Cas9 system comprises a Cas9 molecule, e.g., a Cas9 molecule described herein, e.g., the Cas9 KKH variant.

Following identification, gRNAs can be ranked into tiers based on their distance to the target site, their orthogonality and presence of a 5' G (based on identification of close matches in the human genome containing a relevant PAM (e.g., for a *S. aureus* Cas9 KKH variant, the PAM may be a NNNRRT PAM (e.g., a NNNAGT PAM, a NNNGGT PAM, a NNNGAT PAM, or a NNNAAT PAM).

Alterations of the PI domain, which mediates PAM recognition are discussed below.

Synthetic Cas9 Molecules And Cas9 Polypeptides With Altered PI Domains Current genome-editing methods are limited in the diversity of target sequences that can be targeted by the PAM sequence that is recognized by the Cas9 molecule utilized. A synthetic Cas9 molecule (or Syn-Cas9 molecule), or synthetic Cas9 polypeptide (or syn-Cas9 polypeptide), as that term is used herein, refers to a Cas9 molecule or Cas9 polypeptide that comprises a Cas9 core domain from one bacterial species and a functional altered PI domain, i.e., a PI domain other than that naturally associated with the Cas9 core domain, e.g., from a different bacterial species.

In an embodiment, the altered PI domain recognizes a PAM sequence that is different from the PAM sequence recognized by the naturally-occurring Cas9 from which the Cas9 core domain is derived. In an embodiment, the altered PI domain recognizes the same PAM sequence recognized by the naturally-occurring Cas9 from which the Cas9 core domain is derived, but with different affinity or specificity. A Syn-Cas9 molecule or Syn-Cas9 polypeptide can be, respectively, a Syn-eaCas9 molecule or Syn-eaCas9 polypeptide or a Syn-eiCas9 molecule Syn-eiCas9 polypeptide.

An exemplary Syn-Cas9 molecule Syn-Cas9 polypeptide comprises:

a) a Cas9 core domain, e.g., a Cas9 core domain from Table III.1 or 3, e.g., a *S. aureus, S. pyogenes*, or *C. jejuni* Cas9 core domain; and b) an altered PI domain from a species X Cas9 sequence selected from Tables III.4 and 111.5.

In an embodiment, the RKR motif (the PAM binding motif) of said altered PI domain comprises: differences at 1, 2, or 3 amino acid residues; a difference in amino acid sequence at the first, second, or third position; differences in amino acid sequence at the first and second positions, the first and third positions, or the second and third positions; as compared with the sequence of the RKR motif of the native or endogenous PI domain associated with the Cas9 core domain.

In an embodiment, the Cas9 core domain comprises the Cas9 core domain from a species X Cas9 from Table III.1 and said altered PI domain comprises a PI domain from a species Y Cas9 from Table III.1.

In an embodiment, the RKR motif of the species X Cas9 is other than the RKR motif of the species Y Cas9.

In an embodiment, the RKR motif of the altered PI domain is selected from XXY, XNG, and XNQ.

In an embodiment, the altered PI domain has at least 60, 70, 80, 81, 82, 83, 84, 85, 86, 87, 88, 89, 90, 91, 92, 93, 94, 95, 96, 97, 98, 99 or 100% homology with the amino acid sequence of a naturally occurring PI domain of said species Y from Table III.1.

In an embodiment, the altered PI domain differs by no more than 50, 40, 30, 25, 20, 19, 18, 17, 16, 15, 14, 13, 12, 11, 10, 9, 8, 7, 6, 5, 4, 3, 2, or 1 amino acid residue from the amino acid sequence of a naturally occurring PI domain of said second species from Table III.1.

In an embodiment, the Cas9 core domain comprises a *S. aureus* core domain and altered PI domain comprises: an *A. denitrificans* PI domain; a *C. jejuni* PI domain; a *H. mustelae* PI domain; or an altered PI domain of species X PI domain, wherein species X is selected from Table III.4 or Table III.5.

In an embodiment, the Cas9 core domain comprises a *S. pyogenes* core domain and the altered PI domain comprises: an *A. denitrificans* PI domain; a *C. jejuni* PI domain; a *H. mustelae* PI domain; or an altered PI domain of species X PI domain, wherein species X is selected from Table III.4 or Table III.5.

In an embodiment, the Cas9 core domain comprises a *C. jejuni* core domain and the altered PI domain comprises: an *A. denitrificans* PI domain; a *H. mustelae* PI domain; or an altered PI domain of species X PI domain, wherein species X is selected from Table III.4 or Table III.5.

In an embodiment, the Cas9 molecule further comprises a linker disposed between said Cas9 core domain and said altered PI domain.

In an embodiment, the linker comprises: a linker described elsewhere herein disposed between the Cas9 core domain and the heterologous PI domain.

Exemplary altered PI domains for use in Syn-Cas9 molecules are described in Tables 111.4 and 111.5. The sequences for the 83 Cas9 orthologs referenced in Tables III.4 and 111.5 are provided in Table III.1. Table III.2 provides the Cas9 orthologs with known PAM sequences and the corresponding RKR motif.

In an embodiment, a Syn-Cas9 molecule may also be size-optimized, e.g., the Syn-Cas9 molecule comprises one or more deletions, and optionally one or more linkers disposed between the amino acid residues flanking the deletions. In an embodiment, a Syn-Cas9 molecule comprises a REC deletion.

Size-Optimized Cas9 Molecules

Engineered Cas9 molecules and engineered Cas9 polypeptides, as described herein, include a Cas9 molecule or Cas9 polypeptide comprising a deletion that reduces the size of the molecule while still retaining desired Cas9 properties, e.g., essentially native conformation, Cas9 nuclease activity, and/or target nucleic acid molecule recognition. Provided herein are Cas9 molecules or Cas9 polypeptides comprising one or more deletions, and optionally one or more linkers, wherein a linker is disposed between the amino acid residues that flank the deletion. Methods for identifying suitable deletions in a reference Cas9 molecule, methods for generating Cas9 molecules with a deletion and a linker, and methods for using such Cas9 molecules will be apparent to one of ordinary skill in the art upon review of this document.

A Cas9 molecule, e.g., a *S. aureus, S. pyogenes,* or *C. jejuni,* Cas9 molecule, having a deletion is smaller, e.g., has reduced number of amino acids, than the corresponding naturally-occurring Cas9 molecule. The smaller size of the Cas9 molecules allows increased flexibility for delivery methods, and thereby increases utility for genome-editing. A Cas9 molecule can comprise one or more deletions that do not substantially affect or decrease the activity of the resultant Cas9 molecules described herein. Activities that are retained in the Cas9 molecules comprising a deletion as described herein include one or more of the following:

a nickase activity, i.e., the ability to cleave a single strand, e.g., the non-complementary strand or the complementary strand, of a nucleic acid molecule; a double stranded nuclease activity, i.e., the ability to cleave both strands of a double stranded nucleic acid and create a double strand break, which in an embodiment is the presence of two nickase activities;

an endonuclease activity;

an exonuclease activity;

a helicase activity, i.e., the ability to unwind the helical structure of a double stranded nucleic acid;

and recognition activity of a nucleic acid molecule, e.g., a target nucleic acid or a gRNA.

Activity of the Cas9 molecules described herein can be assessed using the activity assays described herein or in the art.

Identifying Regions Suitable for Deletion

Suitable regions of Cas9 molecules for deletion can be identified by a variety of methods. Naturally-occurring orthologous Cas9 molecules from various bacterial species, e.g., any one of those listed in Table III.1, can be modeled onto the crystal structure of *S. pyogenes* Cas9 (Nishimasu et al. (2014) CELL, 156: 935-949) to examine the level of conservation across the selected Cas9 orthologs with respect to the three-dimensional conformation of the protein. Less conserved or unconserved regions that are located spatially distant from regions involved in Cas9 activity, e.g., the interface with a target nucleic acid molecule and/or gRNA, represent regions or domains that are candidates for deletion without substantially affecting or decreasing Cas9 activity.

REC-Optimized Cas9 Molecules

A REC-optimized Cas9 molecule, as that term is used herein, refers to a Cas9 molecule that comprises a deletion in one or both of the REC2 domain and the $RE1_{CT}$ domain (collectively a REC deletion), wherein the deletion comprises at least 10% of the amino acid residues in the cognate domain. A REC-optimized Cas9 molecule can be an eaCas9 molecule or an eiCas9 molecule. An exemplary REC-optimized Cas9 molecule comprises:

a) a deletion selected from:

i) a REC2 deletion;

ii) a $REC1_{CT}$ deletion; or iii) a $REC1_{SUB}$ deletion.

Optionally, a linker is disposed between the amino acid residues that flank the deletion. In an embodiment a Cas9 molecule includes only one deletion, or only two deletions. A Cas9 molecule can comprise a REC2 deletion and a $REC1_{CT}$ deletion. A Cas9 molecule can comprise a REC2 deletion and a $REC1_{SUB}$ deletion.

Generally, the deletion will contain at least 10% of the amino acids in the cognate domain, e.g., a REC2 deletion will include at least 10% of the amino acids in the REC2 domain.

A deletion can comprise: at least 10, 20, 30, 40, 50, 60, 70, 80, or 90% of the amino acid residues of its cognate domain; all of the amino acid residues of its cognate domain; an amino acid residue outside its cognate domain; a plurality of amino acid residues outside its cognate domain; the amino acid residue immediately N terminal to its cognate domain; the amino acid residue immediately C terminal to its cognate domain; the amino acid residue immediately N terminal to its cognate and the amino acid residue immediately C terminal to its cognate domain; a plurality of, e.g., up to 5, 10, 15, or 20, amino acid residues N terminal to its cognate domain; a plurality of, e.g., up to 5, 10, 15, or 20, amino acid residues C terminal to its cognate domain; a plurality of, e.g., up to 5, 10, 15, or 20, amino acid residues N terminal to its cognate domain and a plurality of e.g., up to 5, 10, 15, or 20, amino acid residues C terminal to its cognate domain.

In an embodiment, a deletion does not extend beyond: its cognate domain; the N terminal amino acid residue of its cognate domain; the C terminal amino acid residue of its cognate domain.

A REC-optimized Cas9 molecule can include a linker disposed between the amino acid residues that flank the deletion. Linkers for use in generating recombinant proteins, e.g., multi-domain proteins, are known in the art (Chen et al. (2013) ADV. DRUG DELIVERY REV. 65:1357-69). Any linkers known in the art that maintain the conformation or native fold of the Cas9 molecule (thereby retaining Cas9 activity) can be used. Several properties of linkers, such as length, hydrophobicity, intrinsic properties of the amino acids residues themselves, and secondary structure should be considered in the context of the goal to maintain native conformation and functional activity of Cas9. Any linkers known in the art that maintain the conformation or native fold of the Cas9 molecule (thereby retaining Cas9 activity) can be used. Several properties of linkers, such as length, hydrophobicity, intrinsic properties of the amino acids residues themselves, and secondary structure should be considered in the context of the goal to maintain native conformation and functional activity of Cas9.

A flexible linker can be utilized in the Cas9 molecules described herein. Flexible linkers allow a certain degree of movement and/or interaction within and between the joined domains or regions of the protein. Generally, flexible linkers are composed of small, non-polar (e.g., Gly) or polar (e.g., Ser or Thr) amino acids. The small size of these amino acids provides flexibility and allows mobility of the connected domains or regions. Furthermore, the incorporation of Ser or Thr can help maintain the stability of the linker in aqueous solutions by hydrogen bonding with the water molecules, thereby reducing unfavorable interactions between the linker and the other protein moieties. Commonly used flexible linkers are comprised of sequences that primarily consist of Gly and Ser residues. Often, these flexible linkers consist of repeating units of a combination of Gly and Ser residues, e.g., (GGS)$_x$, where the number of repeating units, e.g., x, can be optimized to achieve the appropriate separation of other domains or regions of the protein.

In some cases, a rigid linker may be preferred if there is significant distance between the joined domains or regions, or to maintain a fixed distance between the joined domains or regions of a protein and independent functions of the domains/regions. Rigid linkers often have defined secondary structure, e.g., alpha helix, or other stabilizing interactions, e.g., salt bridges and disulfide bonds. Rigid linkers commonly contain multiple Pro residues, or repeating combinations of Glu-Pro or Lys-Pro because Pro imposes a strong conformation constraint due to its structure.

The linker can comprise an amino acid residue, e.g., 1, 2, 3, 4, 5, 6, 7, 8, 9, or 10 amino acid residues. Typically, the linker will comprises less than 10, 20 or 30 amino acid residues. Typically, the linker is less than 50, 40, 30, 20, 10, or 5% of the length of the deleted sequence. Suitable linkers include: [Gly-Ser]$_x$, wherein x is 1, 2, 3, 4, 5, 6, 7, 8, 9, or 10 (SEQ ID NO: 341); [Gly-Gly-Ser]$_x$, wherein x is 1, 2, 3, 4, 5, 6, 7, 8, 9, or 10 (SEQ ID NO: 339); [Gly-Gly-Ser]; [Gly-Ser-Gly-Ser]$_x$, wherein x is 1, 2, 3, 4, or 5 (SEQ ID NO: 127); [Gly-Ser-Gly-Ser] (SEQ ID NO: 128); (GSAGSAAGSGEF)$_x$, wherein x is 1, 2, 3 or 4 (SEQ ID NO: 201); (SIVAQLSRPDPA)$_x$(SEQ ID NO: 202), wherein x is 1, 2, 3 or 4; or an XTEN sequence, e.g., the XTEN sequence of SEQ ID NO: #_, or a sequence that differs therefrom by no more than 1, 2, 3, 4, 5, 6, 7, 8, 9 or 10 amino acid residues. In an embodiment linker comprises an amino acid sequence other than a sequence within REC2.

In an embodiment, a REC-optimized Cas9 molecule comprises an amino acid sequence that, other than any REC deletion and associated linker, has at least 50, 55, 60, 65, 70, 75, 80, 81, 82, 83, 84, 85, 86, 87, 88, 89, 90, 91, 92, 93, 94, 95, 96, 97, 98, 99, or 100% homology with the amino acid sequence of a naturally occurring Cas9, e.g., a Cas9 molecule described in Table III.1, e.g., a *S. aureus* Cas9 molecule, a *S. pyogenes* Cas9 molecule, or a *C. jejuni* Cas9 molecule.

In an embodiment, a REC-optimized Cas9 molecule comprises an amino acid sequence that, other than any REC deletion and associated linker, differs by no more than 1, 2, 3, 4, 5, 6, 7, 8, 9, 10, 11, 12, 13, 14, 15, 16, 17, 18, 19, 20, 21, 22, 23, 24, or 25 amino acid residues from the amino acid sequence of a naturally occurring Cas9, e.g., a Cas9 molecule described in Table III.1, e.g., a *S. aureus* Cas9 molecule, a *S. pyogenes* Cas9 molecule, or a *C. jejuni* Cas9 molecule.

In an embodiment, a REC-optimized Cas9 molecule comprises an amino acid sequence that, other than any REC deletion and associate linker, differs by no more than 1, 2, 3, 4, 5, 6, 7, 8, 9, 10, 11, 12, 13, 14, 15, 16, 17, 18, 19, 20, 21, 22, 23, 24, or 25% of the amino acid residues from the amino acid sequence of a naturally occurring Cas9, e.g., a Cas9 molecule described in Table III.1, e.g., a *S. aureus* Cas9 molecule, a *S. pyogenes* Cas9 molecule, or a *C. jejuni* Cas9 molecule.

For sequence comparison, typically one sequence acts as a reference sequence, to which test sequences are compared. When using a sequence comparison algorithm, test and reference sequences are entered into a computer, subsequence coordinates are designated, if necessary, and sequence algorithm program parameters are designated. Default program parameters can be used, or alternative parameters can be designated. The sequence comparison algorithm then calculates the percent sequence identities for the test sequences relative to the reference sequence, based on the program parameters. Methods of alignment of sequences for comparison are well known in the art. Optimal alignment of sequences for comparison can be conducted, e.g., by the local homology algorithm of Smith and Waterman (1970) Adv. Appl. Math. 2: 482c, by the homology alignment algorithm of Needleman and Wunsch, (1970) J. Mol. Biol. 48:443, by the search for similarity method of Pearson and Lipman, (1988) Proc. Nat'l. Acad. Sci. USA 85:2444, by computerized implementations of these algorithms (GAP, BESTFIT, FASTA, and TFASTA in the Wisconsin Genetics Software Package, Genetics Computer Group, 575 Science Dr., Madison, Wis.), or by manual alignment and visual inspection (see, e.g., Brent et al., (2003) Current Protocols in Molecular Biology).

Two examples of algorithms that are suitable for determining percent sequence identity and sequence similarity are the BLAST and BLAST 2.0 algorithms, which are described in Altschul et al. (1977) Nuc. Acids Res. 25: 3389-3402; and Altschul et al. (1990) J. Mol. Biol. 215: 403-410, respectively. Software for performing BLAST analyses is publicly available through the National Center for Biotechnology Information.

The percent identity between two amino acid sequences can also be determined using the algorithm of E. Meyers and W. Miller (1988) Comput. Appl. Biosci. 4:11-17, which has been incorporated into the ALIGN program (version 2.0), using a PAM120 weight residue table, a gap length penalty of 12 and a gap penalty of 4. In addition, the percent identity between two amino acid sequences can be determined using the Needleman and Wunsch (1970) J. Mol. Biol. 48:444-453 algorithm which has been incorporated into the GAP program in the GCG software package (available at www.gcg-.com), using either a Blossom 62 matrix or a PAM250 matrix, and a gap weight of 16, 14, 12, 10, 8, 6, or 4 and a length weight of 1, 2, 3, 4, 5, or 6.

Sequence information for exemplary REC deletions are provided for 83 naturally-occurring Cas9 orthologs in Table III.1.

The amino acid sequences of exemplary Cas9 molecules from different bacterial species are shown below.

TABLE III.1

Amino Acid Sequence of Cas9 Orthologs

| Species/Composite ID | Amino acid sequence | REC2 | | | REC1$_{CT}$ | | | REC$_{sub}$ | | |
|---|---|---|---|---|---|---|---|---|---|---|
| | | start (AA pos) | stop (AA pos) | # AA deleted (n) | start (AA pos) | stop (AA pos) | # AA deleted (n) | start (AA pos) | stop (AA pos) | # AA deleted (n) |
| *Staphylococcus aureus* tr\|J7RUA5\|J7RUA5_STAAU | SEQ ID NO: 6 | 126 | 166 | 41 | 296 | 352 | 57 | 296 | 352 | 57 |
| *Streptococcus pyogenes* sp\|Q99ZW2\|CAS9_STRP1 | SEQ ID NO: 7 | 176 | 314 | 139 | 511 | 592 | 82 | 511 | 592 | 82 |

TABLE III.1-continued

Amino Acid Sequence of Cas9 Orthologs

| | | REC2 | | | REC1$_{CT}$ | | | REC$_{sub}$ | | |
|---|---|---|---|---|---|---|---|---|---|---|
| Species/Composite ID | Amino acid sequence | start (AA pos) | stop (AA pos) | # AA deleted (n) | start (AA pos) | stop (AA pos) | # AA deleted (n) | start (AA pos) | stop (AA pos) | # AA deleted (n) |
| *Campylobacter jejuni* NCTC 11168 gi\|218563121\|ref\|YP_002344900.1 | SEQ ID NO: 8 | 137 | 181 | 45 | 316 | 360 | 45 | 316 | 360 | 45 |
| *Bacteroides fragilis* NCTC 9343 gi\|60683389\|ref\|YP_213533.1\| | SEQ ID NO: 9 | 148 | 339 | 192 | 524 | 617 | 84 | 524 | 617 | 84 |
| *Bifidobacterium bifidum* S17 gi\|310286728\|ref\|YP_003937986. | SEQ ID NO: 10 | 173 | 335 | 163 | 516 | 607 | 87 | 516 | 607 | 87 |
| *Veillonella atypica* ACS-134-V-Col7a gi\|303229466\|ref\|ZP_07316256.1 | SEQ ID NO: 11 | 185 | 339 | 155 | 574 | 663 | 79 | 574 | 663 | 79 |
| *Lactobacillus rhamnosus* GG gi\|258509199\|ref\|YP_003171950.1 | SEQ ID NO: 12 | 169 | 320 | 152 | 559 | 645 | 78 | 559 | 645 | 78 |
| *Filifactor alocis* ATCC 35896 gi\|374307738\|ref\|YP_005054169.1 | SEQ ID NO: 13 | 166 | 314 | 149 | 508 | 592 | 76 | 508 | 592 | 76 |
| *Oenococcus kitaharae* DSM 17330 gi\|366983953\|gb\|EHN59352.1\| | SEQ ID NO: 14 | 169 | 317 | 149 | 555 | 639 | 80 | 555 | 639 | 80 |
| *Fructobacillus fructosus* KCTC 3544 gi\|339625081\|ref\|ZP_08660870.1 | SEQ ID NO: 15 | 168 | 314 | 147 | 488 | 571 | 76 | 488 | 571 | 76 |
| *Catenibacterium mitsuokai* DSM 15897 gi\|224543312\|ref\|ZP_03683851.1 | SEQ ID NO: 16 | 173 | 318 | 146 | 511 | 594 | 78 | 511 | 594 | 78 |
| *Finegoldia magna* ATCC 29328 gi\|169823755\|ref\|YP_001691366.1 | SEQ ID NO: 17 | 168 | 313 | 146 | 452 | 534 | 77 | 452 | 534 | 77 |
| *CoriobacteriumglomeransPW2* gi\|328956315\|ref\|YP_004373648.1 | SEQ ID NO: 18 | 175 | 318 | 144 | 511 | 592 | 82 | 511 | 592 | 82 |
| *Eubacterium yurii* ATCC 43715 gi\|306821691\|ref\|ZP_07455288.1 | SEQ ID NO: 19 | 169 | 310 | 142 | 552 | 633 | 76 | 552 | 633 | 76 |
| *Peptoniphilus duerdenii* ATCC BAA-1640 gi\|304438954\|ref\|ZP_07398877.1 | SEQ ID NO: 20 | 171 | 311 | 141 | 535 | 615 | 76 | 535 | 615 | 76 |
| *Acidaminococcus sp.* D21 gi\|227824983\|ref\|ZP_03989815.1 | SEQ ID NO: 21 | 167 | 306 | 140 | 511 | 591 | 75 | 511 | 591 | 75 |
| *Lactobacillus farciminis* KCTC 3681 gi\|336394882\|ref\|ZP_08576281.1 | SEQ ID NO: 22 | 171 | 310 | 140 | 542 | 621 | 85 | 542 | 621 | 85 |
| *Streptococcus sanguinis* SK49 gi\|422884106\|ref\|ZP_16930555.1 | SEQ ID NO: 23 | 185 | 324 | 140 | 411 | 490 | 85 | 411 | 490 | 85 |
| *Coprococcus catus* GD-7 gi\|291520705\|emb\|CBK78998.1\| | SEQ ID NO: 24 | 172 | 310 | 139 | 556 | 634 | 76 | 556 | 634 | 76 |
| *Streptococcus mutans* UA159 gi\|24379809\|ref\|NP_721764.1\| | SEQ ID NO: 25 | 176 | 314 | 139 | 392 | 470 | 84 | 392 | 470 | 84 |
| *Streptococcus pyogenes* M1 GAS gi\|13622193\|gb\|AAK33936.1\| | SEQ ID NO: 26 | 176 | 314 | 139 | 523 | 600 | 82 | 523 | 600 | 82 |
| *Streptococcus thermophilus* LMD-9 gi\|116628213\|ref\|YP_820832.1\| | SEQ ID NO: 27 | 176 | 314 | 139 | 481 | 558 | 81 | 481 | 558 | 81 |
| *Fusobacteriumnucleatum* ATCC49256 gi\|34762592\|ref\|ZP_00143587.1\| | SEQ ID NO: 28 | 171 | 308 | 138 | 537 | 614 | 76 | 537 | 614 | 76 |
| *Planococcus antarcticus* DSM 14505 gi\|389815359\|ref\|ZP_10206685.1 | SEQ ID NO: 29 | 162 | 299 | 138 | 538 | 614 | 94 | 538 | 614 | 94 |
| *Treponema denticola* ATCC 35405 gi\|42525843\|ref\|NP_970941.1\| | SEQ ID NO: 30 | 169 | 305 | 137 | 524 | 600 | 81 | 524 | 600 | 81 |
| *Solobacterium moorei* F0204 gi\|320528778\|ref\|ZP_08029929.1 | SEQ ID NO: 31 | 179 | 314 | 136 | 544 | 619 | 77 | 544 | 619 | 77 |
| *Staphylococcus pseudintermedius* ED99 gi\|323463801\|gb\|ADX75954.1\| | SEQ ID NO: 32 | 164 | 299 | 136 | 531 | 606 | 92 | 531 | 606 | 92 |
| *Flavobacterium branchiophilum* FL-15 gi\|347536497\|ref\|YP_004843922.1 | SEQ ID NO: 33 | 162 | 286 | 125 | 538 | 613 | 63 | 538 | 613 | 63 |
| *Ignavibacterium album* JCM 16511 gi\|385811609\|ref\|YP_005848005.1 | SEQ ID NO: 34 | 223 | 329 | 107 | 357 | 432 | 90 | 357 | 432 | 90 |
| *Bergeyella zoohelcum* ATCC 43767 gi\|423317190\|ref\|ZP_17295095.1 | SEQ ID NO: 35 | 165 | 261 | 97 | 529 | 604 | 56 | 529 | 604 | 56 |

TABLE III.1-continued

Amino Acid Sequence of Cas9 Orthologs

| Species/Composite ID | Amino acid sequence | REC2 | | | REC1$_{CT}$ | | | REC$_{sub}$ | | |
|---|---|---|---|---|---|---|---|---|---|---|
| | | start (AA pos) | stop (AA pos) | # AA deleted (n) | start (AA pos) | stop (AA pos) | # AA deleted (n) | start (AA pos) | stop (AA pos) | # AA deleted (n) |
| Nitrobacter hamburgensis X14 gi\|92109262\|ref\|YP_571550.1\| | SEQ ID NO: 36 | 169 | 253 | 85 | 536 | 611 | 48 | 536 | 611 | 48 |
| Odoribacter laneus YIT 12061 gi\|374384763\|ref\|ZP_09642280.1 | SEQ ID NO: 37 | 164 | 242 | 79 | 535 | 610 | 63 | 535 | 610 | 63 |
| Legionella pneumophila str. Paris gi\|54296138\|ref\|YP_122507.1\| | SEQ ID NO: 38 | 164 | 239 | 76 | 402 | 476 | 67 | 402 | 476 | 67 |
| Bacteroides sp. 20 3 gi\|301311869\|ref\|ZP_07217791.1 | SEQ ID NO: 39 | 198 | 269 | 72 | 530 | 604 | 83 | 530 | 604 | 83 |
| Akkermansia muciniphila ATCC BAA-835 gi\|187736489\|ref\|YP_001878601. | SEQ ID NO: 40 | 136 | 202 | 67 | 348 | 418 | 62 | 348 | 418 | 62 |
| Prevotella sp. C561 gi\|345885718\|ref\|ZP_08837074.1 | SEQ ID NO: 41 | 184 | 250 | 67 | 357 | 425 | 78 | 357 | 425 | 78 |
| Wolinella succinogenes DSM 1740 gi\|34557932\|ref\|NP_907747.1\| | SEQ ID NO: 42 | 157 | 218 | 36 | 401 | 468 | 60 | 401 | 468 | 60 |
| Alicyclobacillus hesperidum URH17-3-68 gi\|403744858\|ref\|ZP_10953934.1 | SEQ ID NO: 43 | 142 | 196 | 55 | 416 | 482 | 61 | 416 | 482 | 61 |
| Caenispirillum salinarum AK4 gi\|427429481\|ref\|ZP_18919511.1 | SEQ ID NO: 44 | 161 | 214 | 54 | 330 | 393 | 68 | 330 | 393 | 68 |
| Eubacterium rectale ATCC 33656 gi\|238924075\|ref\|YP_002937591.1 | SEQ ID NO: 45 | 133 | 185 | 53 | 322 | 384 | 60 | 322 | 384 | 60 |
| Mycoplasma synoviae 53 gi\|71894592\|ref\|YP_278700.1\| | SEQ ID NO: 46 | 187 | 239 | 53 | 319 | 381 | 80 | 319 | 381 | 80 |
| Porphyromonas sp. oral taxon 279 str. F0450 gi\|402847315\|ref\|ZP_10895610.1 | SEQ ID NO: 47 | 150 | 202 | 53 | 309 | 371 | 60 | 309 | 371 | 60 |
| Streptococcus thermophilus LMD-9 gi\|116627542\|ref\|YP_820161.1\| | SEQ ID NO: 48 | 127 | 178 | 139 | 424 | 486 | 81 | 424 | 486 | 81 |
| Roseburia inulinivorans DSM 16841 gi\|225377804\|ref\|ZP_03755025.1 | SEQ ID NO: 49 | 154 | 204 | 51 | 318 | 380 | 69 | 318 | 380 | 69 |
| Methylosinus trichosporium OB3b gi\|296446027\|ref\|ZP_06887976.1 | SEQ ID NO: 50 | 144 | 193 | 50 | 426 | 488 | 64 | 426 | 488 | 64 |
| Ruminococcus albus 8 gi\|325677756\|ref\|ZP_08157403.1 | SEQ ID NO: 51 | 139 | 187 | 49 | 351 | 412 | 55 | 351 | 412 | 55 |
| Bifidobacterium longum DJO10A gi\|189440764\|ref\|YP_001955845. | SEQ ID NO: 52 | 183 | 230 | 48 | 370 | 431 | 44 | 370 | 431 | 44 |
| Enterococcus faecalis TX0012 gi\|315149830\|gb\|EFT93846.1\| | SEQ ID NO: 53 | 123 | 170 | 48 | 327 | 387 | 60 | 327 | 387 | 60 |
| Mycoplasma mobile 163K gi\|47458868\|ref\|YP_015730.1\| | SEQ ID NO: 54 | 179 | 226 | 48 | 314 | 374 | 79 | 314 | 374 | 79 |
| Actinomyces coleocanis DSM 15436 gi\|227494853\|ref\|ZP_03925169.1 | SEQ ID NO: 55 | 147 | 193 | 47 | 358 | 418 | 40 | 358 | 418 | 40 |
| Dinoroseobacter shibae DFL 12 gi\|159042956\|ref\|YP_001531750.1 | SEQ ID NO: 56 | 138 | 184 | 47 | 338 | 398 | 48 | 338 | 398 | 48 |
| Actinomyces sp. oral taxon 180 str. F0310 gi\|315605738\|ref\|ZP_07880770.1 | SEQ ID NO: 57 | 183 | 228 | 46 | 349 | 409 | 40 | 349 | 409 | 40 |
| Alcanivorax sp. W11-5 gi\|407803669\|ref\|ZP_11150502.1 | SEQ ID NO: 58 | 139 | 183 | 45 | 344 | 404 | 61 | 344 | 404 | 61 |
| Aminomonas paucivorans DSM 12260 gi\|312879015\|ref\|ZP_07738815.1 | SEQ ID NO: 59 | 134 | 178 | 45 | 341 | 401 | 63 | 341 | 401 | 63 |
| Mycoplasma canis PG 14 gi\|384393286\|gb\|EIE39736.1\| | SEQ ID NO: 60 | 139 | 183 | 45 | 319 | 379 | 76 | 319 | 379 | 76 |
| Lactobacillus coryniformis KCTC 3535 gi\|336393381\|ref\|ZP_08574780.1 | SEQ ID NO: 61 | 141 | 184 | 44 | 328 | 387 | 61 | 328 | 387 | 61 |
| Elusimicrobium minutum Pei191 gi\|187250660\|ref\|YP_001875142.1 | SEQ ID NO: 62 | 177 | 219 | 43 | 322 | 381 | 47 | 322 | 381 | 47 |
| Neisseria meningitidis Z2491 gi\|218767588\|ref\|YP_002342100.1 | SEQ ID NO: 63 | 147 | 189 | 43 | 360 | 419 | 61 | 360 | 419 | 61 |

TABLE III.1-continued

Amino Acid Sequence of Cas9 Orthologs

| | | REC2 | | | REC1$_{CT}$ | | | REC$_{sub}$ | | |
|---|---|---|---|---|---|---|---|---|---|---|
| Species/Composite ID | Amino acid sequence | start (AA pos) | stop (AA pos) | # AA deleted (n) | start (AA pos) | stop (AA pos) | # AA deleted (n) | start (AA pos) | stop (AA pos) | # AA deleted (n) |
| Pasteurella multocida str. Pm70 gi\|15602992\|ref\|NP_246064.1\| | SEQ ID NO: 64 | 139 | 181 | 43 | 319 | 378 | 61 | 319 | 378 | 61 |
| Rhodovulum sp. PH10 gi\|402849997\|ref\|ZP_10898214.1 | SEQ ID NO: 65 | 141 | 183 | 43 | 319 | 378 | 48 | 319 | 378 | 48 |
| Eubacterium dolichum DSM 3991 gi\|160915782\|ref\|ZP_02077990.1 | SEQ ID NO: 66 | 131 | 172 | 42 | 303 | 361 | 59 | 303 | 361 | 59 |
| Nitratifractor salsuginis DSM 16511 gi\|319957206\|ref\|YP_004168469.1 | SEQ ID NO: 67 | 143 | 184 | 42 | 347 | 404 | 61 | 347 | 404 | 61 |
| Rhodospirillum rubrum ATCC 11170 gi\|83591793\|ref\|YP_425545.1\| | SEQ ID NO: 68 | 139 | 180 | 42 | 314 | 371 | 55 | 314 | 371 | 55 |
| Clostridium cellulolyticum H10 gi\|220930482\|ref\|YP_002507391.1 | SEQ ID NO: 69 | 137 | 176 | 40 | 320 | 376 | 61 | 320 | 376 | 61 |
| Helicobacter mustelae 12198 gi\|291276265\|ref\|YP_003516037.1 | SEQ ID NO: 70 | 148 | 187 | 40 | 298 | 354 | 48 | 298 | 354 | 48 |
| Ilyobacter polytropus DSM 2926 gi\|310780384\|ref\|YP_003968716.1 | SEQ ID NO: 71 | 134 | 173 | 40 | 462 | 517 | 63 | 462 | 517 | 63 |
| Sphaerochaeta globus str. Buddy gi\|325972003\|ref\|YP_004248194.1 | SEQ ID NO: 72 | 163 | 202 | 40 | 335 | 389 | 45 | 335 | 389 | 45 |
| Staphylococcus lugdunensis M23590 gi\|315659848\|ref\|ZP_07912707.1 | SEQ ID NO: 73 | 128 | 167 | 40 | 337 | 391 | 57 | 337 | 391 | 57 |
| Treponema sp. JC4 gi\|384109266\|ref\|ZP_10010146.1 | SEQ ID NO: 74 | 144 | 183 | 40 | 328 | 382 | 63 | 328 | 382 | 63 |
| uncultured delta proteobacterium HF0070 07E19 gi\|297182908\|gb\|ADI19058.1\| | SEQ ID NO: 75 | 154 | 193 | 40 | 313 | 365 | 55 | 313 | 365 | 55 |
| Alicycliphilus denitrificans K601 gi\|330822845\|ref\|YP_004386148.1 | SEQ ID NO: 76 | 140 | 178 | 39 | 317 | 366 | 48 | 317 | 366 | 48 |
| Azospirillum sp. B510 gi\|288957741\|ref\|YP_003448082.1 | SEQ ID NO: 77 | 205 | 243 | 39 | 342 | 389 | 46 | 342 | 389 | 46 |
| Bradyrhizobium sp. BTAi1 gi\|148255343\|ref\|YP_001239928.1 | SEQ ID NO: 78 | 143 | 181 | 39 | 323 | 370 | 48 | 323 | 370 | 48 |
| Parvibaculum lavamentivorans DS-1 gi\|154250555\|ref\|YP_001411379.1 | SEQ ID NO: 79 | 138 | 176 | 39 | 327 | 374 | 58 | 327 | 374 | 58 |
| Prevotella timonensis CRIS 5C-B1 gi\|282880052\|ref\|ZP_06288774.1 | SEQ ID NO: 80 | 170 | 208 | 39 | 328 | 375 | 61 | 328 | 375 | 61 |
| Bacillus smithii 7 3 47FAA gi\|365156657\|ref\|ZP_09352959.1 | SEQ ID NO: 81 | 134 | 171 | 38 | 401 | 448 | 63 | 401 | 448 | 63 |
| Cand. Puniceispirillum marinum IMCC1322 gi\|294086111\|ref\|YP_003552871.1 | SEQ ID NO: 82 | 135 | 172 | 38 | 344 | 391 | 53 | 344 | 391 | 53 |
| Barnesiella intestinihominis YIT 11860 gi\|404487228\|ref\|ZP_11022414.1 | SEQ ID NO: 83 | 140 | 176 | 37 | 371 | 417 | 60 | 371 | 417 | 60 |
| Ralstonia syzygii R24 gi\|344171927\|emb\|CCA84553.1\| | SEQ ID NO: 84 | 140 | 176 | 37 | 395 | 440 | 50 | 395 | 440 | 50 |
| Wolinella succinogenes DSM 1740 gi\|34557790\|ref\|NP_907605.1\| | SEQ ID NO: 86 | 145 | 180 | 36 | 348 | 392 | 60 | 348 | 392 | 60 |
| Mycoplasma gallisepticum str. F gi\|284931710\|gb\|ADC31648.1\| | SEQ ID NO: 87 | 144 | 177 | 34 | 373 | 416 | 71 | 373 | 416 | 71 |
| Acidothermus cellulolyticus 11B gi\|117929158\|ref\|YP_873709.1\| | SEQ ID NO: 88 | 150 | 182 | 33 | 341 | 380 | 58 | 341 | 380 | 58 |
| Mycoplasma ovipneumoniae SC01 gi\|363542550\|ref\|ZP_09312133.1 | SEQ ID NO: 89 | 156 | 184 | 29 | 381 | 420 | 62 | 381 | 420 | 62 |

If any of the above Cas9 sequences are fused with a peptide or polypeptide at the C-terminus, it is understood that the stop codon will be removed.

Exemplary PAM sequences and their corresponding RKR motifs are provided in Table III.2.

TABLE III.2

Identified PAM sequences and corresponding RKR motifs.

| Strain Name | PAM sequence (NA) | RKR motif (AA) |
|---|---|---|
| Streptococcus pyogenes | NGG | RKR |
| Streptococcus mutans | NGG | RKR |
| Streptococcus thermophilus A | NGGNG (SEQ ID NO: 90) | RYR |
| Treponema denticola | NAAAAN (SEQ ID NO: 96) | VAK |
| Streptococcus thermophilus B | NNAAAAW (SEQ ID NO: 97) | IYK |
| Campylobacter jejuni | NNNNACA (SEQ ID NO: 98) | NLK |
| Pasteurella multocida | GNNNCNNA (SEQ ID NO: 99) | KDG |
| Neisseria meningitidis | NNNNGATT (SEQ ID NO: 94) or NNGRRT (R = A or G) (SEQ ID NO: 95) | IGK |

TABLE III.2-continued

Identified PAM sequences and corresponding RKR motifs.

| Strain Name | PAM sequence (NA) | RKR motif (AA) |
|---|---|---|
| Staphylococcus aureus | NNGRR (R = A or G) (SEQ ID NO: 93) | NDK |

Exemplary Cas9 core domains are provided in Table III.3.

TABLE III.3

Amino Acid Sequence of Cas9 Core Domains

| Strain Name | Cas9 Start (AA pos) | Cas9 Stop (AA pos) |
|---|---|---|
| | Start and Stop numbers refer to the sequence in Table III.1 | |
| Staphylococcus aureus | 1 | 772 |
| Streptococcus pyogenes | 1 | 1099 |
| Campulobacter jejuni | 1 | 741 |

Exemplary PI domains, e.g., altered PI domains, are provided in Tables III.4 and III.5.

TABLE III.4

Altered PI Domains

| Strain Name | PI Start (AA pos) | PI Stop (AA POS) | Length of PI (AA) | RKR motif (AA) |
|---|---|---|---|---|
| | Start and Stop numbers refer to the sequences in Table III.1 | | | |
| Alicycliphilus denitrificans K601 | 837 | 1029 | 193 | --Y |
| Campylobacter jejuni NCTC 11168 | 741 | 984 | 244 | -NG |
| Helicobacter mustelae 12198 | 771 | 1024 | 254 | -NQ |

TABLE III.5

Other Altered PI Domains

| Strain Name | PI Start (AA pos) | PI Stop (AA Pos) | Length of PI (AA) | RKR motif (AA) |
|---|---|---|---|---|
| | Start and Stop numbers refer to the sequences in Table III.1 | | | |
| Akkermansia muciniphila ATCC BAA-835 | 871 | 1101 | 231 | ALK |
| Ralstonia syzygii R24 | 821 | 1062 | 242 | APY |
| Cand. Puniceispirillum marinum IMCC1322 | 815 | 1035 | 221 | AYK |
| Fructobacillus fructosus KCTC 3544 | 1074 | 1323 | 250 | DGN |
| Eubacterium yurii ATCC 43715 | 1107 | 1391 | 285 | DGY |
| Eubacterium dolichum DSM 3991 | 779 | 1096 | 318 | DKK |
| Dinoroseobacter shibae DFL 12 | 851 | 1079 | 229 | DPI |
| Clostridium cellulolyticum H10 | 767 | 1021 | 255 | EGK |
| Pasteurella multocida str. Pm70 | 815 | 1056 | 242 | ENN |
| Mycoplasma canis PG 14 | 907 | 1233 | 327 | EPK |
| Porphyromonas sp. oral taxon 279 str. F0450 | 935 | 1197 | 263 | EPT |
| Filifactor alocis ATCC 35896 | 1094 | 1365 | 272 | EVD |
| Aminomonas paucivorans DSM 12260 | 801 | 1052 | 252 | EVY |
| Wolinella succinogenes DSM 1740 | 1034 | 1409 | 376 | EYK |
| Oenococcus kitaharae DSM 17330 | 1119 | 1389 | 271 | GAL |
| CoriobacteriumglomeransPW2 | 1126 | 1384 | 259 | GDR |
| Peptoniphilus duerdenii ATCC BAA-1640 | 1091 | 1364 | 274 | GDS |
| Bifidobacterium bifidum S17 | 1138 | 1420 | 283 | GGL |
| Alicyclobacillus hesperidum URH17-3-68 | 876 | 1146 | 271 | GGR |
| Roseburia inulinivorans DSM 16841 | 895 | 1152 | 258 | GGT |
| Actinomyces coleocanis DSM 15436 | 843 | 1105 | 263 | GKK |
| Odoribacter laneus YIT 12061 | 1103 | 1498 | 396 | GKV |
| Coprococcus catus GD-7 | 1063 | 1338 | 276 | GNQ |
| Enterococcus faecalis TX0012 | 829 | 1150 | 322 | GRK |

TABLE III.5-continued

Other Altered PI Domains

| Strain Name | PI Start (AA pos) | PI Stop (AA Pos) | Length of PI (AA) | RKR motif (AA) |
|---|---|---|---|---|
| Bacillus smithii 7 3 47FAA | 809 | 1088 | 280 | GSK |
| Legionella pneumophila str. Paris | 1021 | 1372 | 352 | GTM |
| Bacteroides fragilis NCTC 9343 | 1140 | 1436 | 297 | IPV |
| Mycoplasma ovipneumoniae SC01 | 923 | 1265 | 343 | IRI |
| Actinomyces sp. oral taxon 180 str. F0310 | 895 | 1181 | 287 | KEK |
| Treponema sp. JC4 | 832 | 1062 | 231 | KIS |
| Fusobacteriumnucleatum ATCC49256 | 1073 | 1374 | 302 | KKV |
| Lactobacillus farciminis KCTC 3681 | 1101 | 1356 | 256 | KKV |
| Nitratifractor salsuginis DSM 16511 | 840 | 1132 | 293 | KMR |
| Lactobacillus coryniformis KCTC 3535 | 850 | 1119 | 270 | KNK |
| Mycoplasma mobile 163K | 916 | 1236 | 321 | KNY |
| Flavobacterium branchiophilum FL-15 | 1182 | 1473 | 292 | KQK |
| Prevotella timonensis CRIS 5C-B1 | 957 | 1218 | 262 | KQQ |
| Methylosinus trichosporium OB3b | 830 | 1082 | 253 | KRP |
| Prevotella sp. C561 | 1099 | 1424 | 326 | KRY |
| Mycoplasma gallisepticum str. F | 911 | 1269 | 359 | KTA |
| Lactobacillus rhamnosus GG | 1077 | 1363 | 287 | KYG |
| Wolinella succinogenes DSM 1740 | 811 | 1059 | 249 | LPN |
| Streptococcus thermophilus LMD-9 | 1099 | 1388 | 290 | MLA |
| Treponema denticola ATCC 35405 | 1092 | 1395 | 304 | NDS |
| Bergeyella zoohelcum ATCC 43767 | 1098 | 1415 | 318 | NEK |
| Veillonella atypica ACS-134-V-Col7a | 1107 | 1398 | 292 | NGF |
| Neisseria meningitidis Z2491 | 835 | 1082 | 248 | NHN |
| Ignavibacterium album JCM 16511 | 1296 | 1688 | 393 | NKK |
| Ruminococcus albus 8 | 853 | 1156 | 304 | NNF |
| Streptococcus thermophilus LMD-9 | 811 | 1121 | 311 | NNK |
| Barnesiella intestinihominis YIT 11860 | 871 | 1153 | 283 | NPV |
| Azospirillum sp. B510 | 911 | 1168 | 258 | PFH |
| Rhodospirillum rubrum ATCC 11170 | 863 | 1173 | 311 | PRG |
| Planococcus antarcticus DSM 14505 | 1087 | 1333 | 247 | PYY |
| Staphylococcus pseudintermedius ED99 | 1073 | 1334 | 262 | QIV |
| Alcanivorax sp. W11-5 | 843 | 1113 | 271 | RIE |
| Bradyrhizobium sp. BTAi1 | 811 | 1064 | 254 | RIY |
| Streptococcus pyogenes M1 GAS | 1099 | 1368 | 270 | RKR |
| Streptococcus mutans UA159 | 1078 | 1345 | 268 | RKR |
| Streptococcus Pyogenes | 1099 | 1368 | 270 | RKR |
| Bacteroides sp. 20 3 | 1147 | 1517 | 371 | RNI |
| S. aureus | 772 | 1053 | 282 | RNK |
| Solobacterium moorei F0204 | 1062 | 1327 | 266 | RSG |
| Finegoldia magna ATCC 29328 | 1081 | 1348 | 268 | RTE |
| uncultured delta proteobacterium HF0070 07E19 | 770 | 1011 | 242 | SGG |
| Acidaminococcus sp. D21 | 1064 | 1358 | 295 | SIG |
| Eubacterium rectale ATCC 33656 | 824 | 1114 | 291 | SKK |
| Caenispirillum salinarum AK4 | 1048 | 1442 | 395 | SLV |
| Acidothermus cellulolyticus 11B | 830 | 1138 | 309 | SPS |
| Catenibacterium mitsuokai DSM 15897 | 1068 | 1329 | 262 | SPT |
| Parvibaculum lavamentivorans DS-1 | 827 | 1037 | 211 | TGN |
| Staphylococcus lugdunensis M23590 | 772 | 1054 | 283 | TKK |
| Streptococcus sanguinis SK49 | 1123 | 1421 | 299 | TRM |
| Elusimicrobium minutum Pei191 | 910 | 1195 | 286 | TTG |
| Nitrobacter hamburgensis X14 | 914 | 1166 | 253 | VAY |
| Mycoplasma synoviae 53 | 991 | 1314 | 324 | VGF |
| Sphaerochaeta globus str. Buddy | 877 | 1179 | 303 | VKG |
| Ilyobacter polytropus DSM 2926 | 837 | 1092 | 256 | VNG |
| Rhodovulum sp. PH10 | 821 | 1059 | 239 | VPY |
| Bifidobacterium longum DJO10A | 904 | 1187 | 284 | VRK |

Additional Cas9 molecules are discussed in the section entitled "II. Cas9 Molecules" in International Application WO2015/048577.

Nucleic Acids Encoding Cas9 Molecules

Nucleic acids encoding the Cas9 molecules or Cas9 polypeptides, e.g., an eaCas9 molecule or eaCas9 polypeptides, are provided herein.

Exemplary nucleic acids encoding Cas9 molecules are described in Cong et al., SCIENCE 2013, 399(6121): 819-823; Wang et al., CELL 2013, 153(4): 910-918; Mali et al., SCIENCE 2013, 399(6121): 823-826; Jinek et al., SCIENCE 2012, 337(6096): 816-821.

In an embodiment, a nucleic acid encoding a Cas9 molecule, or Cas9 polypeptide, can be a synthetic nucleic acid sequence. For example, the synthetic nucleic acid molecule can be chemically modified, e.g., as described in Section X. In an embodiment, the mRNA, e.g., coding for a Cas9 molecule, or Cas9 polypeptide, disclosed herein, has one or more, e.g., all, of the following properties: it is capped, polyadenylated, substituted with 5-methylcytidine and/or pseudouridine.

In addition, or alternatively, the synthetic nucleic acid sequence can be codon optimized, e.g., at least one non-common codon or less-common codon has been replaced by a codon that is common in the host cell. For example, the synthetic nucleic acid can direct the synthesis of an optimized messenger mRNA, e.g., optimized for expression in a mammalian expression system, e.g., described herein.

In addition, or alternatively, a nucleic acid encoding a Cas9 molecule, or a Cas9 polypeptide, may comprise a nuclear localization sequence (NLS). Nuclear localization sequences are known in the art.

Provided below is an exemplary codon optimized nucleic acid sequence encoding a Cas9 molecule of *S. pyogenes*.

(SEQ ID NO: __)
ATGGATAAAAAGTACAGCATCGGGCTGGACATCGGTACAAACTCAGTGGG
GTGGGCCGTGATTACGGACGAGTACAAGGTACCCTCCAAAAAATTTAAAG
TGCTGGGTAACACGGACAGACACTCTATAAAGAAAAATCTTATTGGAGCC
TTGCTGTTCGACTCAGGCGAGACAGCCGAAGCCACAAGGTTGAAGCGGAC
CGCCAGGAGGCGGTATACCAGGAGAAAGAACCGCATATGCTACCTGCAAG
AAATCTTCAGTAACGAGATGGCAAAGGTTGACGATAGCTTTTTCCATCGC
CTGGAAGAATCCTTTCTTGTTGAGGAAGACAAGAAGCACGAACGGCACCC
CATCTTTGGCAATATTGTCGACGAAGTGGCATATCACGAAAAGTACCCGA
CTATCTACCACCTCAGGAAGAAGCTGGTGGACTCTACCGATAAGGCGGAC
CTCAGACTTATTTATTTGGCACTCGCCCACATGATTAAATTTAGAGGACA
TTTCTTGATCGAGGGCGACCTGAACCCGGACAACAGTGACGTCGATAAGC
TGTTCATCCAACTTGTGCAGACCTACAATCAACTGTTCGAAGAAAACCCT
ATAAATGCTTCAGGAGTCGACGCTAAAGCAATCCTGTCCGCGCGCCTCTC
AAAATCTAGAAGACTTGAGAATCTGATTGCTCAGTTGCCCGGGGAAAAGA
AAAATGGATTGTTTGGCAACCTGATCGCCCTCAGTCTCGGACTGACCCCA
AATTTCAAAAGTAACTTCGACCTGGCCGAAGACGCTAAGCTCCAGCTGTC
CAAGGACACATACGATGACGACCTCGACAATCTGCTGGCCCAGATTGGGG
ATCAGTACGCCGATCTCTTTTTGGCAGCAAAGAACCTGTCCGACGCCATC
CTGTTGAGCGATATCTTGAGAGTGAACACCGAAATTACTAAAGCACCCCT
TAGCGCATCTATGATCAAGCGGTACGACGAGCATCATCAGGATCTGACCC
TGCTGAAGGCTCTTGTGAGGCAACAGCTCCCCGAAAAATACAAGGAAATC
TTCTTTGACCAGAGCAAAAACGGCTACGCTGGCTATATAGATGGTGGGGC
CAGTCAGGAGGAATTCTATAAATTCATCAAGCCCATTCTCGAGAAAATGG
ACGGCACAGAGGAGTTGCTGGTCAAACTTAACAGGGAGGACCTGCTGCGG
AAGCAGCGGACCTTTGACAACGGGTCTATCCCCCACCAGATTCATCTGGG
CGAACTGCACGCAATCCTGAGGAGGCAGGAGGATTTTTATCCTTTTCTTA
AAGATAACCGCGAGAAAATAGAAAAGATTCTTACATTCAGGATCCCGTAC
TACGTGGGACCTCTCGCCCGGGGCAATTCACGGTTTGCCTGGATGACAAG
GAAGTCAGAGGAGACTATTACACCTTGGAACTTCGAAGAAGTGGTGGACA
AGGGTGCATCTGCCCAGTCTTTCATCGAGCGGATGACAAATTTTGACAAG
AACCTCCCTAATGAGAAGGTGCTGCCCAAACATTCTCTGCTCTACGAGTA
CTTTACCGTCTACAATGAACTGACTAAAGTCAAGTACGTCACCGAGGGAA
TGAGGAAGCCGGCATTCCTTAGTGGAGAACAGAAGAAGGCGATTGTAGAC
CTGTTGTTCAAGACCAACAGGAAGGTGACTGTGAAGCAACTTAAAGAAGA
CTACTTTAAGAAGATCGAATGTTTTGACAGTGTGGAAATTTCAGGGGTTG
AAGACCGCTTCAATGCGTCATTGGGGACTTACCATGATCTTCTCAAGATC

ATAAAGGACAAAGACTTCCTGGACAACGAAGAAAATGAGGATATTCTCGA
AGACATCGTCCTCACCCTGACCCTGTTCGAAGACAGGGAAATGATAGAAG
AGCGCTTGAAAACCTATGCCCACCTCTTCGACGATAAAGTTATGAAGCAG
CTGAAGCGCAGGAGATACACAGGATGGGGAAGATTGTCAAGGAAGCTGAT
CAATGGAATTAGGGATAAACAGAGTGGCAAGACCATACTGGATTTCCTCA
AATCTGATGGCTTCGCCAATAGGAACTTCATGCAACTGATTCACGATGAC
TCTCTTACCTTCAAGGAGGACATTCAAAAGGCTCAGGTGAGCGGGCAGGG
AGACTCCCTTCATGAACACATCGCGAATTTGGCAGGTTCCCCCGCTATTA
AAAAGGGCATCCTTCAAACTGTCAAGGTGGTGGATGAATTGGTCAAGGTA
ATGGGCAGACATAAGCCAGAAAATATTGTGATCGAGATGGCCCGCGAAAA
CCAGACCACACAGAAGGGCCAGAAAAATAGTAGAGAGCGGATGAAGAGGA
TCGAGGAGGGCATCAAAGAGCTGGGATCTCAGATTCTCAAAGAACACCCC
GTAGAAAACACACAGCTGCAGAACGAAAAATTGTACTTGTACTATCTGCA
GAACGGCAGAGACATGTACGTCGACCAAGAACTTGATATTAATAGACTGT
CCGACTATGACGTAGACCATATCGTGCCCCAGTCCTTCCTGAAGGACGAC
TCCATTGATAACAAAGTCTTGACAAGAAGCGACAAGAACAGGGGTAAAAG
TGATAATGTGCCTAGCGAGGAGGTGGTGAAAAAAATGAAGAACTACTGGC
GACAGCTGCTTAATGCAAAGCTCATTACACAACGGAAGTTCGATAATCTG
ACGAAAGCAGAGAGAGGTGGCTTGTCTGAGTTGGACAAGGCAGGGTTTAT
TAAGCGGCAGCTGGTGGAAACTAGGCAGATCACAAAGCACGTGGCGCAGA
TTTTGGACAGCCGGATGAACACAAAATACGACGAAAATGATAAACTGATA
CGAGAGGTCAAAGTTATCACGCTGAAAAGCAAGCTGGTGTCCGATTTTCG
GAAAGACTTCCAGTTCTACAAAGTTCGCGAGATTAATAACTACCATCATG
CTCACGATGCGTACCTGAACGCTGTTGTCGGGACCGCCTTGATAAAGAAG
TACCCAAAGCTGGAATCCGAGTTCGTATACGGGGATTACAAAGTGTACGA
TGTGAGGAAAATGATAGCCAAGTCCGAGCAGGAGATTGGAAAGGCCACAG
CTAAGTACTTCTTTTATTCTAACATCATGAATTTTTTTAAGACGGAAATT
ACCCTGGCCAACGGAGAGATCAGAAAGCGGCCCCTTATAGAGACAAATGG
TGAAACAGGTGAAATCGTCTGGGATAAGGGCAGGGATTTCGCTACTGTGA
GGAAGGTGCTGAGTATGCCACAGGTAAATATCGTGAAAAAAACCGAAGTA
CAGACCGGAGGATTTTCCAAGGAAAGCATTTTGCCTAAAAGAAACTCAGA
CAAGCTCATCGCCCGCAAGAAAGATTGGGACCCTAAGAAATACGGGGGAT
TTGACTCACCCACCGTAGCCTATTCTGTGCTGGTGGTAGCTAAGGTGGAA
AAAGGAAAGTCTAAGAAGCTGAAGTCCGTGAAGGAACTCTTGGGAATCAC
TATCATGGAAAGATCATCCTTTGAAAAGAACCCTATCGATTTCCTGGAGG
CTAAGGGTTACAAGGAGGTCAAGAAAGACCTCATCATTAAACTGCCAAAA
TACTCTCTCTTCGAGCTGGAAAATGGCAGGAAGAGAATGTTGGCCAGCGC
CGGAGAGCTGCAAAAGGGAAACGAGCTTGCTCTGCCCTCCAAATATGTTA
ATTTTCTCTATCTCGCTTCCCACTATGAAAAGCTGAAAGGGTCTCCCGAA
GATAACGAGCAGAAGCAGCTGTTCGTCGAACAGCACAAGCACTATCTGGA

-continued
TGAAATAATCGAACAAATAAGCGAGTTCAGCAAAAGGGTTATCCTGGCGG

ATGCTAATTTGGACAAAGTACTGTCTGCTTATAACAAGCACCGGGATAAG

CCTATTAGGGAACAAGCCGAGAATATAATTCACCTCTTTACACTCACGAA

TCTCGGAGCCCCGCCGCCTTCAAATACTTTGATACGACTATCGACCGGA

AACGGTATACCAGTACCAAAGAGGTCCTCGATGCCACCCTCATCCACCAG

TCAATTACTGGCCTGTACGAAACACGGATCGACCTCTCTCAACTGGGCGG

CGACTAG

Provided below is the corresponding amino acid sequence of a *S. pyogenes* Cas9 molecule.

(SEQ ID NO: __)
MDKKYSIGLDIGTNSVGWAVITDEYKVPSKKFKVLGNTDRHSIKKNLIGA
LLFDSGETAEATRLKRTARRRYTRRKNRICYLQEIFSNEMAKVDDSFFHR
LEESFLVEEDKKHERHPIFGNIVDEVAYHEKYPTIYHLRKKLVDSTDKAD
LRLIYLALAHMIKFRGHFLIEGDLNPDNSDVDKLFIQLVQTYNQLFEENP
INASGVDAKAILSARLSKSRRLENLIAQLPGEKKNGLFGNLIALSLGLTP
NFKSNFDLAEDAKLQLSKDTYDDDLDNLLAQIGDQYADLFLAAKNLSDAI
LLSDILRVNTEITKAPLSASMIKRYDEHHQDLTLLKALVRQQLPEKYKEI
FFDQSKNGYAGYIDGGASQEEFYKFIKPILEKMDGTEELLVKLNREDLLR
KQRTFDNGSIPHQIHLGELHAILRRQEDFYPFLKDNREKIEKILTFRIPY
YVGPLARGNSRFAWMTRKSEETITPWNFEEVVDKGASAQSFIERMTNFDK
NLPNEKVLPKHSLLYEYFTVYNELTKVKYVTEGMRKPAFLSGEQKKAIVD
LLFKTNRKVTVKQLKEDYFKKIECFDSVEISGVEDRFNASLGTYHDLLKI
IKDKDFLDNEENEDILEDIVLTLTLFEDREMIEERLKTYAHLFDDKVMKQ
LKRRRYTGWGRLSRKLINGIRDKQSGKTILDFLKSDGFANRNFMQLIHDD
SLTFKEDIQKAQVSGQGDSLHEHIANLAGSPAIKKGILQTVKVVDELVKV
MGRHKPENIVIEMARENQTTQKGQKNSRERMKRIEEGIKELGSQILKEHP
VENTQLQNEKLYLYYLQNGRDMYVDQELDINRLSDYDVDHIVPQSFLKDD
SIDNKVLTRSDKNRGKSDNVPSEEVVKKMKNYWRQLLNAKLITQRKFDNL
TKAERGGLSELDKAGFIKRQLVETRQITKHVAQILDSRMNTKYDENDKLI
REVKVITLKSKLVSDFRKDFQFYKVREINNYHHAHDAYLNAVVGTALIKK
YPKLESEFVYGDYKVYDVRKMIAKSEQEIGKATAKYFFYSNIMNFFKTEI
TLANGEIRKRPLIETNGETGEIVWDKGRDFATVRKVLSMPQVNIVKKTEV
QTGGFSKESILPKRNSDKLIARKKDWDPKKYGGFDSPTVAYSVLVVAKVE
KGKSKKLKSVKELLGITIMERSSFEKNPIDFLEAKGYKEVKKDLIIKLPK
YSLFELENGRKRMLASAGELQKGNELALPSKYVNFLYLASHYEKLKGSPE
DNEQKQLFVEQHKHYLDEIIEQISEFSKRVILADANLDKVLSAYNKHRDK
PIREQAENIIHLFTLTNLGAPAAFKYFDTTIDRKRYTSTKEVLDATLIHQ
SITGLYETRIDLSQLGGD*

Provided below is an exemplary codon optimized nucleic acid sequence encoding a Cas9 molecule of *N. meningitidis*.

(SEQ ID NO: __)
ATGGCCGCCTTCAAGCCCAACCCCATCAACTACATCCTGGGCCTGGACAT
CGGCATCGCCAGCGTGGGCTGGGCCATGGTGGAGATCGACGAGGACGAGA
ACCCCATCTGCCTGATCGACCTGGGTGTGCGCGTGTTCGAGCGCGCTGAG
GTGCCCAAGACTGGTGACAGTCTGGCTATGGCTCGCCGGCTTGCTCGCTC
TGTTCGGCGCCTTACTCGCCGGCGCGCTCACCGCCTTCTGCGCGCTCGCC
GCCTGCTGAAGCGCGAGGGTGTGCTGCAGGCTGCCGACTTCGACGAGAAC
GGCCTGATCAAGAGCCTGCCCAACACTCCTTGGCAGCTGCGCGCTGCCGC
TCTGGACCGCAAGCTGACTCCTCTGGAGTGGAGCGCCGTGCTGCTGCACC
TGATCAAGCACCGCGGCTACCTGAGCCAGCGCAAGAACGAGGGCGAGACC
GCCGACAAGGAGCTGGGTGCTCTGCTGAAGGGCGTGGCCGACAACGCCCA
CGCCCTGCAGACTGGTGACTTCCGCACTCCTGCTGAGCTGGCCCTGAACA
AGTTCGAGAAGGAGAGCGGCCACATCCGCAACCAGCGCGGCGACTACAGC
CACACCTTCAGCCGCAAGGACCTGCAGGCCGAGCTGATCCTGCTGTTCGA
GAAGCAGAAGGAGTTCGGCAACCCCCACGTGAGCGGCGGCCTGAAGGAGG
GCATCGAGACCCTGCTGATGACCCAGCGCCCCGCCCTGAGCGGCGACGCC
GTGCAGAAGATGCTGGGCCACTGCACCTTCGAGCCAGCCGAGCCCAAGGC
CGCCAAGAACACCTACACCGCCGAGCGCTTCATCTGGCTGACCAAGCTGA
ACAACCTGCGCATCCTGGAGCAGGGCAGCGAGCGCCCCCTGACCGACACC
GAGCGCGCCACCCTGATGGACGAGCCCTACCGCAAGAGCAAGCTGACCTA
CGCCCAGGCCCGCAAGCTGCTGGGTCTGGAGGACACCGCCTTCTTCAAGG
GCCTGCGCTACGGCAAGGACAACGCCGAGGCCAGCACCCTGATGGAGATG
AAGGCCTACCACGCCATCAGCCGCGCCCTGGAGAAGGAGGGCCTGAAGGA
CAAGAAGAGTCCTCTGAACCTGAGCCCCGAGCTGCAGGACGAGATCGGCA
CCGCCTTCAGCCTGTTCAAGACCGACGAGGACATCACCGGCCGCCTGAAG
GACCGCATCCAGCCCGAGATCCTGGAGGCCCTGCTGAAGCACATCAGCTT
CGACAAGTTCGTGCAGATCAGCCTGAAGGCCCTGCGCCGCATCGTGCCCC
TGATGGAGCAGGGCAAGCGCTACGACGAGGCCTGCGCCGAGATCTACGGC
GACCACTACGGCAAGAAGAACACCGAGGAGAAGATCTACCTGCCTCCTAT
CCCCGCCGACGAGATCCGCAACCCCGTGGTGCTGCGCGCCCTGAGCCAGG
CCCGCAAGGTGATCAACGGCGTGGTGCGCCGCTACGGCAGCCCCGCCCGC
ATCCACATCGAGACCGCCCGCGAGGTGGGCAAGAGCTTCAAGGACCGCAA
GGAGATCGAGAAGCGCCAGGAGGAGAACCGCAAGGACCGCGAGAAGGCCG
CCGCCAAGTTCCGCGAGTACTTCCCCAACTTCGTGGGCGAGCCCAAGAGC
AAGGACATCCTGAAGCTGCGCCTGTACGAGCAGCAGCACGGCAAGTGCCT
GTACAGCGGCAAGGAGATCAACCTGGCCGCCTGAACGAGAAGGGCTACG
TGGAGATCGACCACGCCCTGCCCTTCAGCCGCACCTGGGACGACAGCTTC
AACAACAAGGTGCTGGTGCTGGGCAGCGAGAACCAGAACAAGGGCAACCA
GACCCCCTACGAGTACTTCAACGGCAAGGACAACAGCCGCGAGTGGCAGG

-continued

AGTTCAAGGCCCGCGTGGAGACCAGCCGCTTCCCCCGCAGCAAGAAGCAG
CGCATCCTGCTGCAGAAGTTCGACGAGGACGGCTTCAAGGAGCGCAACCT
GAACGACACCCGCTACGTGAACCGCTTCCTGTGCCAGTTCGTGGCCGACC
GCATGCGCCTGACCGGCAAGGGCAAGAAGCGCGTGTTCGCCAGCAACGGC
CAGATCACCAACCTGCTGCGCGGCTTCTGGGGCCTGCGCAAGGTGCGCGC
CGAGAACGACCGCCACCACGCCCTGGACGCCGTGGTGGTGGCCTGCAGCA
CCGTGGCCATGCAGCAGAAGATCACCCGCTTCGTGCGCTACAAGGAGATG
AACGCCTTCGACGGTAAAACCATCGACAAGGAGACCGGCGAGGTGCTGCA
CCAGAAGACCCACTTCCCCCAGCCCTGGGAGTTCTTCGCCCAGGAGGTGA
TGATCCGCGTGTTCGGCAAGCCCGACGGCAAGCCCGAGTTCGAGGAGGCC
GACACCCCCGAGAAGCTGCGCACCCTGCTGGCCGAGAAGCTGAGCAGCCG
CCCTGAGGCCGTGCACGAGTACGTGACTCCTCTGTTCGTGAGCCGCGCCC
CCAACCGCAAGATGAGCGGTCAGGGTCACATGGAGACCGTGAAGAGCGCC
AAGCGCCTGGACGAGGGCGTGAGCGTGCTGCGCGTGCCCCTGACCCAGCT
GAAGCTGAAGGACCTGGAGAAGATGGTGAACCGCGAGCGCGAGCCCAAGC
TGTACGAGGCCCTGAAGGCCCGCCTGGAGGCCCACAAGGACGACCCCGCC
AAGGCCTTCGCCGAGCCCTTCTACAAGTACGACAAGGCCGGCAACCGCAC
CCAGCAGGTGAAGGCCGTGCGCGTGGAGCAGGTGCAGAAGACCGGCGTGT
GGGTGCGCAACCACAACGGCATCGCCGACAACGCCACCATGGTGCGCGTG
GACGTGTTCGAGAAGGGCGACAAGTACTACCTGGTGCCCATCTACAGCTG
GCAGGTGGCCAAGGGCATCCTGCCCGACCGCGCCGTGGTGCAGGGCAAGG
ACGAGGAGGACTGGCAGCTGATCGACGACAGCTTCAACTTCAAGTTCAGC
CTGCACCCCAACGACCTGGTGGAGGTGATCACCAAGAAGGCCCGCATGTT
CGGCTACTTCGCCAGCTGCCACCGCGGCACCGGCAACATCAACATCCGCA
TCCACGACCTGGACCACAAGATCGGCAAGAACGGCATCCTGGAGGGCATC
GGCGTGAAGACCGCCCTGAGCTTCCAGAAGTACCAGATCGACGAGCTGGG

CAAGGAGATCCGCCCCTGCCGCCTGAAGAAGCGCCCTCCTGTGCGCTAA

Provided below is the corresponding amino acid sequence of a *N. meningitidis* Cas9 molecule.

(SEQ ID NO: __)

MAAFKPNPINYILGLDIGIASVGWAMVEIDEDENPICLIDLGVRVFERAE

VPKTGDSLAMARRLARSVRRLTRRRAHRLLRARRLLKREGVLQAADFDEN

GLIKSLPNTPWQLRAAALDRKLTPLEWSAVLLHLIKHRGYLSQRKNEGET

ADKELGALLKGVADNAHALQTGDFRTPAELALNKFEKESGHIRNQRGDYS

HTFSRKDLQAELILLFEKQKEFGNPHVSGGLKEGIETLLMTQRPALSGDA

VQKMLGHCTFEPAEPKAAKNTYTAERFIWLTKLNNLRILEQGSERPLTDT

ERATLMDEPYRKSKLTYAQARKLLGLEDTAFFKGLRYGKDNAEASTLMEM

KAYHAISRALEKEGLKDKKSPLNLSPELQDEIGTAFSLFKTDEDITGRLK

DRIQPEILEALLKHISFDKFVQISLKALRRIVPLMEQGKRYDEACAEIYG

DHYGKKNTEEKIYLPPIPADEIRNPVVLRALSQARKVINGVVRRYGSPAR

-continued

IHIETAREVGKSFKDRKEIEKRQEENRKDREKAAAKFREYFPNFVGEPKS

KDILKLRLYEQQHGKCLYSGKEINLGRLNEKGYVEIDHALPFSRTWDDSF

NNKVLVLGSENQNKGNQTPYEYFNGKDNSREWQEFKARVETSRFPRSKKQ

RILLQKFDEDGFKERNLNDTRYVNRFLCQFVADRMRLTGKGKKRVFASNG

QITNLLRGFWGLRKVRAENDRHHALDAVVVACSTVAMQQKITRFVRYKEM

NAFDGKTIDKETGEVLHQKTHFPQPWEFFAQEVMIRVFGKPDGKPEFEEA

DTPEKLRTLLAEKLSSRPEAVHEYVTPLFVSRAPNRKMSGQGHMETVKSA

KRLDEGVSVLRVPLTQLKLKDLEKMVNREREPKLYEALKARLEAHKDDPA

KAFAEPFYKYDKAGNRTQQVKAVRVEQVQKTGVWVRNHNGIADNATMVRV

DVFEKGDKYYLVPIYSWQVAKGILPDRAVVQGKDEDDWQLIDDSFNFKFS

LHPNDLVEVITKKARMFGYFASCHRGTGNINIRIHDLDHKIGKNGILEGI

GVKTALSFQKYQIDELGKEIRPCRLKKRPPVR*

Provided below is an amino acid sequence of a *S. aureus* Cas9 molecule.

(SEQ ID NO: __)

MKRNYILGLDIGITSVGYGIIDYETRDVIDAGVRLFKEANVENNEGRRSK

RGARRLKRRRRHRIQRVKKLLFDYNLLTDHSELSGINPYEARVKGLSQKL

SEEEFSAALLHLAKRRGVHNVNEVEEDTGNELSTKEQISRNSKALEEKYV

AELQLERLKKDGEVRGSINRFKTSDYVKEAKQLLKVQKAYHQLDQSFIDT

YIDLLETRRTYYEGPGEGSPFGWKDIKEWYEMLMGHCTYFPEELRSVKYA

YNADLYNALNDLNNLVITRDENEKLEYYEKFQIIENVFKQKKKPTLKQIA

KEILVNEEDIKGYRVTSTGKPEFTNLKVYHDIKDITARKEIIENAELLDQ

IAKILTIYQSSEDIQEELTNLNSELTQEEIEQISNLKGYTGTHNLSLKAI

NLILDELWHTNDNQIAIFNRLKLVPKKVDLSQQKEIPTTLVDDFILSPVV

KRSFIQSIKVINAIIKKYGLPNDIIIELAREKNSKDAQKMINEMQKRNRQ

TNERIEEIIRTTGKENAKYLIEKIKLHDMQEGKCLYSLEAIPLEDLLNNP

FNYEVDHIIPRSVSFDNSFNNKVLVKQEENSKKGNRTPFQYLSSSDSKIS

YETFKKHILNLAKGKGRISKTKKEYLLEERDINRFSVQKDFINRNLVDTR

YATRGLMNLLRSYFRVNNLDVKVKSINGGFTSFLRRKWKFKKERNKGYKH

HAEDALIIANADFIFKEWKKLDKAKKVMENQMFEEKQAESMPEIETEQEY

KEIFITPHQIKHIKDFKDYKYSHRVDKKPNRELINDTLYSTRKDDKGNTL

IVNNLNGLYDKDNDKLKKLINKSPEKLLMYHHDPQTYQKLKLIMEQYGDE

KNPLYKYYEETGNYLTKYSKKDNGPVIKKIKYYGNKLNAHLDITDDYPNS

RNKVVKLSLKPYRFDVYLDNGVYKFVTVKNLDVIKKENYYEVNSKCYEEA

KKLKKISNQAEFIASFYNNDLIKINGELYRVIGVNNDLLNRIEVNMIDIT

YREYLENMNDKRPPRIIKTIASKTQSIKKYSTDILGNLYEVKSKKHPQII

KKG*

Provided below is an exemplary codon optimized nucleic acid sequence encoding a S. aureus Cas9 molecule.

(SEQ ID NO: __)

ATGAAAAGGAACTACATTCTGGGGCTGGACATCGGGATTACAAGCGTGGG
GTATGGGATTATTGACTATGAAACAAGGGACGTGATCGACGCAGGCGTCA
GACTGTTCAAGGAGGCCAACGTGGAAAACAATGAGGGACGGAGAAGCAAG
AGGGGAGCCAGGCGCCTGAAACGACGGAGAAGGCACAGAATCCAGAGGGT
GAAGAAACTGCTGTTCGATTACAACCTGCTGACCGACCATTCTGAGCTGA
GTGGAATTAATCCTTATGAAGCCAGGGTGAAAGGCCTGAGTCAGAAGCTG
TCAGAGGAAGAGTTTTCCGCAGCTCTGCTGCACCTGGCTAAGCGCCGAGG
AGTGCATAACGTCAATGAGGTGGAAGAGGACACCGGCAACGAGCTGTCTA
CAAAGGAACAGATCTCACGCAATAGCAAAGCTCTGGAAGAGAAGTATGTC
GCAGAGCTGCAGCTGGAACGGCTGAAGAAAGATGGCGAGGTGAGAGGGTC
AATTAATAGGTTCAAGACAAGCGACTACGTCAAAGAAGCCAAGCAGCTGC
TGAAAGTGCAGAAGGCTTACCACCAGCTGGATCAGAGCTTCATCGATACT
TATATCGACCTGCTGGAGACTCGGAGAACCTACTATGAGGGACCAGGAGA
AGGGAGCCCCTTCGGATGGAAAGACATCAAGGAATGGTACGAGATGCTGA
TGGGACATTGCACCTATTTTCCAGAAGAGCTGAGAAGCGTCAAGTACGCT
TATAACGCAGATCTGTACAACGCCCTGAATGACCTGAACAACCTGGTCAT
CACCAGGGATGAAAACGAGAAACTGGAATACTATGAGAAGTTCCAGATCA
TCGAAACGTGTTTAAGCAGAAGAAAAAGCCTACACTGAAACAGATTGCT
AAGGAGATCCTGGTCAACGAAGAGGACATCAAGGGCTACCGGGTGACAAG
CACTGGAAAACCAGAGTTCACCAATCTGAAAGTGTATCACGATATTAAGG
ACATCACAGCACGGAAAGAAATCATTGAGAACGCCGAACTGCTGGATCAG
ATTGCTAAGATCCTGACTATCTACCAGAGCTCCGAGGACATCCAGGAAGA
GCTGACTAACCTGAACAGCGAGCTGACCCAGGAAGAGATCGAACAGATTA
GTAATCTGAAGGGGTACACCGGAACACACAACCTGTCCCTGAAAGCTATC
AATCTGATTCTGGATGAGCTGTGGCATACAAACGACAATCAGATTGCAAT
CTTTAACCGGCTGAAGCTGGTCCCAAAAAAGGTGGACCTGAGTCAGCAGA
AAGAGATCCCAACCACACTGGTGGACGATTTCATTCTGTCACCCGTGGTC
AAGCGGAGCTTCATCCAGAGCATCAAAGTGATCAACGCCATCATCAAGAA
GTACGGCCTGCCCAATGATATCATTATCGAGCTGGCTAGGGAGAAGAACA
GCAAGGACGCACAGAAGATGATCAATGAGATGCAGAAACGAAACCGGCAG
ACCAATGAACGCATTGAAGAGATTATCCGAACTACCGGGAAAGAGAACGC
AAAGTACCTGATTGAAAAAATCAAGCTGCACGATATGCAGGAGGGAAAGT
GTCTGTATTCTCTGGAGGCCATCCCCCTGGAGGACCTGCTGAACAATCCA
TTCAACTACGAGGTCGATCATATTATCCCCAGAAGCGTGTCCTTCGACAA
TTCCTTTAACAACAAGGTGCTGGTCAAGCAGGAAGAGAACTCTAAAAAGG
GCAATAGGACTCCTTTCCAGTACCTGTCTAGTTCAGATTCCAAGATCTCT
TACGAAACCTTTAAAAAGCACATTCTGAATCTGGCCAAAGGAAAGGGCCG
CATCAGCAAGACCAAAAAGGAGTACCTGCTGGAAGAGCGGGACATCAACA

GATTCTCCGTCCAGAAGGATTTTATTAACCGGAATCTGGTGGACACAAGA
TACGCTACTCGCGGCCTGATGAATCTGCTGCGATCCTATTTCCGGGTGAA
CAATCTGGATGTGAAAGTCAAGTCCATCAACGGCGGGTTCACATCTTTTC
TGAGGCGCAAATGGAAGTTTAAAAAGGAGCGCAACAAAGGGTACAAGCAC
CATGCCGAAGATGCTCTGATTATCGCAAATGCCGACTTCATCTTTAAGGA
GTGGAAAAAGCTGGACAAAGCCAAGAAAGTGATGGAGAACCAGATGTTCG
AAGAGAAGCAGGCCGAATCTATGCCCGAAATCGAGACAGAACAGGAGTAC
AAGGAGATTTTCATCACTCCTCACCAGATCAAGCATATCAAGGATTTCAA
GGACTACAAGTACTCTCACCGGGTGGATAAAAAGCCCAACAGAGAGCTGA
TCAATGACACCCTGTATAGTACAAGAAAAGACGATAAGGGGAATACCCTG
ATTGTGAACAATCTGAACGGACTGTACGACAAAGATAATGACAAGCTGAA
AAAGCTGATCAACAAAAGTCCCGAGAAGCTGCTGATGTACCACCATGATC
CTCAGACATATCAGAAACTGAAGCTGATTATGGAGCAGTACGGCGACGAG
AAGAACCCACTGTATAAGTACTATGAAGAGACTGGGAACTACCTGACCAA
GTATAGCAAAAGGATAATGGCCCCGTGATCAAGAAGATCAAGTACTATG
GGAACAAGCTGAATGCCCATCTGGACATCACAGACGATTACCCTAACAGT
CGCAACAAGGTGGTCAAGCTGTCACTGAAGCCATACAGATTCGATGTCTA
TCTGGACAACGGCGTGTATAAATTTGTGACTGTCAAGAATCTGGATGTCA
TCAAAAGGAGAACTACTATGAAGTGAATAGCAAGTGCTACGAAGAGGCT
AAAAAGCTGAAAAAGATTAGCAACCAGGCAGAGTTCATCGCCTCCTTTTA
CAACAACGACCTGATTAAGATCAATGGCGAACTGTATAGGGTCATCGGGG
TGAACAATGATCTGCTGAACCGCATTGAAGTGAATATGATTGACATCACT
TACCGAGAGTATCTGGAAAACATGAATGATAAGCGCCCCCCTCGAATTAT
CAAAACAATTGCCTCTAAGACTCAGAGTATCAAAAAGTACTCAACCGACA
TTCTGGGAAACCTGTATGAGGTGAAGAGCAAAAAGCACCCTCAGATTATC
AAAAAGGGC

If any of the above Cas9 sequences are fused with a peptide or polypeptide at the C-terminus, it is understood that the stop codon will be removed.

Other Cas Molecules and Cas Polypeptides

Various types of Cas molecules or Cas polypeptides can be used to practice the inventions disclosed herein. In some embodiments, Cas molecules of Type II Cas systems are used. In other embodiments, Cas molecules of other Cas systems are used. For example, 15 Type I or Type III Cas molecules may be used. Exemplary Cas molecules (and Cas systems) are described, e.g., in Haft et al. (2005) PLUS COMPUTATIONAL BIOLOGY 1(6): e60, and in Makarova et al. (2011) NATURE REVIEW MICROBIOLOGY 9: 467-477, the contents of which are incorporated herein by reference in their entirety. Exemplary Cas molecules (and Cas systems) are also shown in Table III.6.

TABLE III.6

Cas Systems

| Gene name‡ | System type or subtype | Name from Haft et al.§ | Structure of encoded protein (PDB accessions)¶ | Families (and superfamily) of encoded protein#** | Representatives |
|---|---|---|---|---|---|
| cas1 | Type I<br>Type II<br>Type III | cas1 | 3GOD, 3LFX and 2YZS | COG1518 | SERP2463, SPy1047 and ygbT |
| cas2 | Type I<br>Type II<br>Type III | cas2 | 2IVY, 2I8E and 3EXC | COG1343 and COG3512 | SERP2462, SPy1048, SPy1723 (N-terminal domain) and ygbF |
| cas3′ | Type I‡‡ | cas3 | NA | COG1203 | APE1232 and ygcB |
| cas3″ | Subtype I-A<br>Subtype I-B | NA | NA | COG2254 | APE1231 and BH0336 |
| cas4 | Subtype I-A<br>Subtype I-B<br>Subtype I-C<br>Subtype I-D<br>Subtype II-B | cas4 and csa1 | NA | COG1468 | APE1239 and BH0340 |
| cas5 | Subtype I-A<br>Subtype I-B<br>Subtype I-C<br>Subtype I-E | cas5a, cas5d, cas5e, cas5h, cas5p, cas5t and cmx5 | 3KG4 | COG1688 (RAMP) | APE1234, BH0337, devS and ygcI |
| cas6 | Subtype I-A<br>Subtype I-B<br>Subtype I-D<br>Subtype III-A<br>Subtype III-B | cas6 and cmx6 | 3I4H | COG1583 and COG5551 (RAMP) | PF1131 and slr7014 |
| cas6e | Subtype I-E | cse3 | 1WJ9 | (RAMP) | ygcH |
| cas6f | Subtype I-F | csy4 | 2XLJ | (RAMP) | y1727 |
| cas7 | Subtype I-A<br>Subtype I-B<br>Subtype I-C<br>Subtype I-E | csa2, csd2, cse4, csh2, csp1 and cst2 | NA | COG1857 and COG3649 (RAMP) | devR and ygcJ |
| cas8a1 | Subtype I-A‡‡ | cmx1, cst1, csx8, csx13 and CXXC-CXXC | NA | BH0338-like | LA3191§§ and PG2018§§ |
| cas8a2 | Subtype I-A‡‡ | csa4 and csx9 | NA | PH0918 | AF0070, AF1873, MJ0385, PF0637, PH0918 and SSO1401 |
| cas8b | Subtype I-B‡‡ | csh1 and TM1802 | NA | BH0338-like | MTH1090 and TM1802 |
| cas8c | Subtype I-C‡‡ | csd1 and csp2 | NA | BH0338-like | BH0338 |
| cas9 | Type II‡‡ | csn1 and csx12 | NA | COG3513 | FTN_0757 and SPy1046 |
| cas10 | Type III‡‡ | cmr2, csm1 and csx11 | NA | COG1353 | MTH326, Rv2823c§§ and TM1794§§ |
| cas10d | Subtype I-D‡‡ | csc3 | NA | COG1353 | slr7011 |
| csy1 | Subtype I-F‡‡ | csy1 | NA | y1724-like | y1724 |
| csy2 | Subtype I-F | csy2 | NA | (RAMP) | y1725 |
| csy3 | Subtype I-F | csy3 | NA | (RAMP) | y1726 |
| cse1 | Subtype I-E‡‡ | cse1 | NA | YgcL-like | ygcL |
| cse2 | Subtype I-E | cse2 | 2ZCA | YgcK-like | ygcK |
| csc1 | Subtype I-D | csc1 | NA | alr1563-like (RAMP) | alr1563 |
| csc2 | Subtype I-D | csc1 and csc2 | NA | COG1337 (RAMP) | slr7012 |
| csa5 | Subtype I-A | csa5 | NA | AF1870 | AF1870, MJ0380, PF0643 and SSO1398 |
| csn2 | Subtype II-A | csn2 | NA | SPy1049-like | SPy1049 |
| csm2 | Subtype III-A‡‡ | csm2 | NA | COG1421 | MTH1081 and SERP2460 |
| csm3 | Subtype III-A | csc2 and csm3 | NA | COG1337 (RAMP) | MTH1080 and SERP2459 |
| csm4 | Subtype III-A | csm4 | NA | COG1567 (RAMP) | MTH1079 and SERP2458 |
| csm5 | Subtype III-A | csm5 | NA | COG1332 (RAMP) | MTH1078 and SERP2457 |
| csm6 | Subtype III-A | APE2256 and csm6 | 2WTE | COG1517 | APE2256 and SSO1445 |
| cmr1 | Subtype III-B | cmr1 | NA | COG1367 (RAMP) | PF1130 |
| cmr3 | Subtype III-B | cmr3 | NA | COG1769 (RAMP) | PF1128 |
| cmr4 | Subtype III-B | cmr4 | NA | COG1336 (RAMP) | PF1126 |

TABLE III.6-continued

Cas Systems

| Gene name‡ | System type or subtype | Name from Haft et al.§ | Structure of encoded protein (PDB accessions)¶ | Families (and superfamily) of encoded protein#** | Representatives |
|---|---|---|---|---|---|
| cmr5 | Subtype III-B‡‡ | cmr5 | 2ZOP and 2OEB | COG3337 | MTH324 and PF1125 |
| cmr6 | Subtype III-B | cmr6 | NA | COG1604 (RAMP) | PF1124 |
| csb1 | Subtype I-U | GSU0053 | NA | (RAMP) | Balac__1306 and GSU0053 |
| csb2 | Subtype I-U§§ | NA | NA | (RAMP) | Balac__1305 and GSU0054 |
| csb3 | Subtype I-U | NA | NA | (RAMP) | Balac__1303§§ |
| csx17 | Subtype I-U | NA | NA | NA | Btus__2683 |
| csx14 | Subtype I-U | NA | NA | NA | GSU0052 |
| csx10 | Subtype I-U | csx10 | NA | (RAMP) | Caur__2274 |
| csx16 | Subtype III-U | VVA1548 | NA | NA | VVA1548 |
| csaX | Subtype III-U | csaX | NA | NA | SSO1438 |
| csx3 | Subtype III-U | csx3 | NA | NA | AF1864 |
| csx1 | Subtype III-U | csa3, csx1, csx2, DXTHG, NE0113 and TIGR02710 | 1XMX and 2171 | COG1517 and COG4006 | MJ1666, NE0113, PF1127 and TM1812 |
| csx15 | Unknown | NA | NA | TTE2665 | TTE2665 |
| csf1 | Type U | csf1 | NA | NA | AFE__1038 |
| csf2 | Type U | csf2 | NA | (RAMP) | AFE__1039 |
| csf3 | Type U | csf3 | NA | (RAMP) | AFE__1040 |
| csf4 | Type U | csf4 | NA | NA | AFE__1037 |

Linkers

In one aspect, the Cas9 molecules described herein comprise a REC2 deletion, a REC1$_{CT}$ deletion, and/or a REC1$_{SUB}$ deletion, and a linker disposed between the amino acid residues that flank each deletion, e.g., between the amino acid residues N-terminal and C-terminal to the deletion. Preferably, the linkers used between the amino acid residues that flank each deletion include properties such that the resulting Cas9 molecule properly folds and possesses functional activity. In an embodiment, Cas9 molecules described herein do not contain a linker between the amino acid residues that flank a deletion.

In another aspect, the Cas9 molecule described herein comprises a linker disposed between a Cas9 core domain (comprising a REC2 deletion, a REC1$_{CT}$ deletion, and/or a REC1$_{SUB}$ deletion) and a heterologous PI domain. The linker is disposed between the C-terminus of the Cas9 core domain and the N-terminus of a heterologous PI domain. In some embodiments, the Cas9 molecule does not contain a linker disposed between a Cas9 core domain and a heterologous PI domain, e.g., the C-terminus of the Cas9 core domain is linked to the N-terminus of the heterologous PI domain.

Linkers for use in generating recombinant proteins, e.g., multi-domain proteins, are known in the art (Chen et al., Adv Drug Delivery Rev, 65:1357-69, 2013). As an example. any linkers known in the art that maintain the conformation or native fold of the Cas9 molecule (thereby retaining Cas9 activity) can be used. Several properties of linkers, such as length, hydrophobilicty, intrinsic properties of the amino acids residues themselves, and secondary structure should be considered in the context of the goal to maintain native conformation and functional activity of Cas9.

A flexible linker can be utilized in the Cas9 molecules described herein. Flexible linkers allow a certain degree of movement and/or interaction within and between the joined domains or regions of the protein. Generally, flexible linkers are composed of small, non-polar (e.g., Gly) or polar (e.g., Ser or Thr) amino acids. The small size of these amino acids provides flexibility and allows mobility of the connected domains or regions. Furthermore, the incorporation of Ser or Thr can help maintain the stability of the linker in aqueous solutions by hydrogen bonding with the water molecules, thereby reducing unfavorable interactions between the linker and the other protein moieties. Commonly used flexible linkers are comprised of sequences that primarily consist of Gly and Ser residues. Often, these flexible linkers consist of repeating units of a combination of Gly and Ser residues, e.g., (GGS)$_x$, where the number of repeating units, e.g., x, can be optimized to achieve the appropriate separation of other domains or regions of the protein.

In some cases, a rigid linker may be preferred if there is significant distance between the joined domains or regions, or to maintain a fixed distance between the joined domains or regions of a protein and independent functions of the domains/regions. Rigid linkers often have defined secondary structure, e.g., alpha helix, or other stabilizing interactions, e.g., salt bridges and disulfide bonds. Rigid linkers commonly contain multiple Pro residues, or repeating combinations of Glu-Pro or Lys-Pro because Pro imposes a strong conformation constraint due to its structure.

In an embodiment, the linker comprises:

1, 2, 3, 4, 5, 6, 7, 8, 9, 10, 15, or 20 amino acid residues;

Less than 10, 20 or 30 amino acid residues;

(GGS)x, wherein x is 1, 2, 3, 4, 5, 6, 7, 8, 9, or 10 (SEQ ID NO: 339);

(GS)x, wherein x is 1, 2, 3, 4, 5, 6, 7, 8, 9, or 10 (SEQ ID NO: 341); or (SGSETPGTSESATPES)x, where x is 1, 2, 3, or 4 (also referred to herein interchangeably as XTEN or the XTEN linker) (SEQ ID NO: 344). Alternative linkers may include (GSAGSAAGSGEF)$_x$, wherein x is 1, 2, 3 or 4 (SEQ ID NO: 345) and (SIVAQLSRPDPA)$_x$, wherein x is 1, 2, 3 or 4 (SEQ ID NO: 346). In some embodiments, a combination of linkers may be used, e.g., a combination of an XTEN linker (or other alternative linker), a (GS)$_x$ linker, and/or a (GGS)$_x$ linker.

In some embodiments, specific linkers may be preferred depending on the specific deleted sequence or region or the heterologous PI domain. Examples of preferred linkers for Cas9 with a REC2 deletion, a REC1$_{CT}$ deletion, or a REC1$_{SUB}$ deletion are provided in further detail below.

In some embodiments, the linker length is from about 6 to 60 amino acids. The linker may be, e.g., 6-10, 10-15, 15-20, 20-30, 30-40, 40-50, or 50-60 amino acids in length. The linker may be, e.g., at least 6, 7, 8, 9, 10, 15, 20, 30, 40, or 50 amino acids in length. In other embodiments, the linker is, e.g., at most 7, 8, 9, 10, 15, 20, 30, 40, 50, or 60 amino acids in length. Ranges comprising any combination of these endpoints are also envisioned.

In some embodiments, the linker is encoded by a nucleic acid sequence of 6 to 60 nucleotides or base pairs. The nucleic acid may be, e.g., 6-10, 10-15, 15-20, 20-30, 30-40, 40-50, or 50-60 nucleotides in length. The linker may be, e.g., at least 6, 7, 8, 9, 10, 15, 20, 30, 40, or 50 nucleotides in length. In some embodiments, the linker is, e.g., at most 7, 8, 9, 10, 15, 20, 30, 40, 50, or 60 nucleotides in length. Ranges comprising any combination of these endpoints are also envisioned.

In some embodiments, the linker comprises glycine and serine residues. In some embodiments the linker consists of glycine and serine residues. For instance, the linker may comprise one or more modules such as GGS, GSGS, GGGS, GGGGS or GGSG. In some embodiments, the linker comprises a plurality of modules comprising glycine and serine, e.g., at least 2, 3, 4, 5, 10, or 15 of these modules, and/or at most 3, 4, 5, 10, 15, or 20 of these modules, or any combination of these endpoints. In some embodiments, each module in the linker has the same sequence, and in other embodiments, at least two modules in a linker have different sequences from each other.

In some embodiments, the linker is an XTEN linker or a variation of an XTEN linker such as SGSETPGTSESA (SEQ ID NO: 135), SGSETPGTSESATPES (SEQ ID NO: 136), or SGSETPGTSESATPEGGSGGS (SEQ ID NO: 137). Additional information on the XTEN linker may be found in Schellenberger et al. (2009), NATURE BIOTECHNOLOGY 27: 1186-1190, the entire contents of which are incorporated herein by reference.

Exemplary linker modules are given in Table IV.

TABLE III.7

Exemplary Linker Modules

GGS

GSGS

GGGS

GGGGS

GGSG

SGSETPGTSESA

SGSETPGTSESATPES

SGSETPGTSESATPEGGSGGS

Additional exemplary linker modules are given in Table V.

TABLE III.8

Exemplary Linker Modules

| Name | Description | Length (nt) |
|---|---|---|
| BBa_J176131 | PLrigid | 60 |
| BBa_J18920 | 2aa GS linker | 6 |
| BBa_J18921 | 6aa [GS]x linker | 18 |
| BBa_J18922 | 10aa [GS]x linker | 30 |
| BBa_K105012 | 10 aa flexible protein domain linker | 30 |
| BBa_K133132 | 8 aa protein domain linker | 24 |
| BBa_K1486003 | flexible linker 2x (GGGS) | 24 |
| BBa_K1486004 | flexible linker 2x (GGGGS) | 30 |
| BBa_K1486037 | linker | 39 |
| BBa_K157009 | Split fluorophore linker; Freiburg standard | 51 |
| BBa_K157013 | 15 aa flexible glycine-serine protein domain linker; Freiburg standard | 45 |
| BBa_K243004 | Short Linker (Gly-Gly-Ser-Gly) | 12 |
| BBa_K243005 | Middle Linker (Gly-Gly-Ser-Gly)x2 | 24 |
| BBa_K243006 | Long Linker (Gly-Gly-Ser-Gly)x3 | 36 |
| BBa_K243029 | GSAT Linker | 108 |
| BBa_K243030 | SEG | 108 |
| BBa_K404300 | SEG-Linker | 108 |
| BBa_K404301 | GSAT-Linker | 108 |
| BBa_K404303 | Z-EGFR-1907_Short-Linker | 192 |
| BBa_K404304 | Z-EGFR-1907_Middle-Linker | 204 |
| BBa_K404305 | Z-EGFR-1907_Long-Linker | 216 |
| BBa_K404306 | Z-EGFR-1907_SEG-Linker | 288 |
| BBa_K416001 | (Gly4Ser)3 Flexible Peptide Linker | 45 |
| BBa_K648005 | Short Fusion Protein Linker: GGSG with standard 25 prefix/suffix | 12 |
| BBa_K648006 | Long 10AA Fusion Protein Linker with Standard 25 Prefix/Suffix | 30 |
| BBa_K648007 | Medium 6AA Fusion Protein Linker: GGSGGS with Standard 25 Prefix/Suffix | 18 |

Linkers can comprise a direct bond or an atom such as, e.g., an oxygen (O) or sulfur (S), a unit such as —NR— wherein R is hydrogen or alkyl, —C(O)—, —C(O)O—, —C(O)NH—, SO, SO$_2$, —SO$_2$NH— or a chain of atoms, such as substituted or unsubstituted alkyl, substituted or unsubstituted alkenyl, substituted or unsubstituted alkynyl, arylalkyl, heteroarylalkyl. In some embodiments, one or more methylenes in the chain of atoms can be replaced with one or more of O, S, S(O), SO$_2$, —SO$_2$NH—, —NR—, —NR$_2$, —C(O)—, —C(O)O—, —C(O)NH—, a cleavable linking group, substituted or unsubstituted aryl, substituted or unsubstituted heteroaryl, and substituted or unsubstituted heterocyclic.

In some embodiments, the linker comprises an alkylene moiety or a heteroalkylene moiety (e.g., an alkylene glycol moiety such as ethylene glycol). In some embodiments, a linker comprises a poly-L-glutamic acid, polylactic acid, poly(ethyleneimine), an oligosaccharide, an amino acid (e.g., glycine), an amino acid chain, or any other suitable linkage. The linker groups can be biologically inactive, such as a PEG, polyglycolic acid, or polylactic acid chain. In certain embodiments, the linker group represents a derivatized or non-derivatized amino acid (e.g., glycine).

The length of the linkers can be easily adjusted by changing the copy number of repeating units to achieve an optimal distance between the domains or regions that are to be joined. In embodiments, the different linkers can be joined together to achieve optimal distance, flexibility, or rigidity between the joined domains or regions of a Cas9 molecule.

IV. Functional Analysis of Candidate Molecules

Candidate Cas9 molecules, candidate gRNA molecules, candidate Cas9 molecule/gRNA molecule complexes, can be evaluated by art-known methods or as described herein. For example, exemplary methods for evaluating the endonuclease activity of Cas9 molecule are described, e.g., in Jinek et al. (2012) SCIENCE 337(6096): 816-821. The methods in this section may be used, e.g., to test various portions of a gRNA, for example, the targeting domain, the first complementarity domain, the linking domain, the 25 second complementarity domain, the proximal domain, or the tail domain. In some embodiments, the methods in this section are tested to determine whether modifications made in one or more of these domains interfere with targeting efficacy. A gRNA with a selected length, sequence, degree of complementarity, or degree of modification, can be evaluated in a system of this section.

Binding and Cleavage Assay: Testing the Endonuclease Activity of Cas9 Molecule

The ability of a Cas9 molecule/gRNA molecule complex to bind to and cleave a target nucleic acid can be evaluated in a plasmid cleavage assay. In this assay, synthetic or in vitro-transcribed gRNA molecule is pre-annealed prior to the reaction by heating to 95° C. and slowly cooling down to room temperature. Native or restriction digest-linearized plasmid DNA (300 ng (~8 nM)) is incubated for 60 mM at 37° C. with purified Cas9 protein molecule (50-500 nM) and gRNA (50-500 nM, 1:1) in a Cas9 plasmid cleavage buffer (20 mM HEPES pH 7.5, 150 mM KCl, 0.5 mM DTT, 0.1 mM EDTA) with or without 10 mM $MgCl_2$. The reactions are stopped with 5×DNA loading buffer (30% glycerol, 1.2% SDS, 250 mM EDTA), resolved by a 0.8 or 1% agarose gel electrophoresis and visualized by ethidium bromide staining. The resulting cleavage products indicate whether the Cas9 molecule cleaves both DNA strands, or only one of the two strands. For example, linear DNA products indicate the cleavage of both DNA strands. Nicked open circular products indicate that only one of the two strands is cleaved.

Alternatively, the ability of a Cas9 molecule/gRNA molecule complex to bind to and cleave a target nucleic acid can be evaluated in an oligonucleotide DNA cleavage assay. In this assay, DNA oligonucleotides (10 pmol) are radiolabeled by incubating with 5 units T4 polynucleotide kinase and ~3-6 pmol (~20-40 mCi) [γ-32P]-ATP in 1× T4 polynucleotide kinase reaction buffer at 37° C. for 30 mM, in a 50 µL reaction. After heat inactivation (65° C. for 20 mM), reactions are purified through a column to remove unincorporated label. Duplex substrates (100 nM) are generated by annealing labeled oligonucleotides with equimolar amounts of unlabeled complementary oligonucleotide at 95° C. for 3 mM, followed by slow cooling to room temperature. For cleavage assays, gRNA molecules are annealed by heating to 95° C. for 30 s, followed by slow cooling to room temperature. Cas9 (500 nM final concentration) is pre-incubated with the annealed gRNA molecules (500 nM) in cleavage assay buffer (20 mM HEPES pH 7.5, 100 mM KCl, 5 mM MgCl2, 1 mM DTT, 5% glycerol) in a total volume of 9 µl. Reactions are initiated by the addition of 1 µl target DNA (10 nM) and incubated for 1 h at 37° C. Reactions are quenched by the addition of 20 µl of loading dye (5 mM EDTA, 0.025% SDS, 5% glycerol in formamide) and heated to 95° C. for 5 min. Cleavage products are resolved on 12% denaturing polyacrylamide gels containing 7 M urea and visualized by phosphorimaging. The resulting cleavage products indicate that whether the complementary strand, the non-complementary strand, or both, are cleaved.

One or both of these assays can be used to evaluate the suitability of a candidate gRNA molecule or candidate Cas9 molecule.

Binding Assay: Testing the Binding of Cas9 Molecule to Target DNA

Exemplary methods for evaluating the binding of Cas9 molecule to target DNA are described, e.g., in Jinek et al. 2012 SCIENCE 337(6096): 816-821.

For example, in an electrophoretic mobility shift assay, target DNA duplexes are formed by mixing of each strand (10 nmol) in deionized water, heating to 95° C. for 3 min and slow cooling to room temperature. All DNAs are purified on 8% native gels containing 1× TBE. DNA bands are visualized by UV shadowing, excised, and eluted by soaking gel pieces in DEPC-treated $H_2O$. Eluted DNA is ethanol precipitated and dissolved in DEPC-treated $H_2O$. DNA samples are 5' end labeled with [γ-32P]-ATP using T4 polynucleotide kinase for 30 min at 37° C. Polynucleotide kinase is heat denatured at 65° C. for 20 min, and unincorporated radiolabel is removed using a column Binding assays are performed in buffer containing 20 mM HEPES pH 7.5, 100 mM KCl, 5 mM $MgCl_2$, 1 mM DTT and 10% glycerol in a total volume of 10 µl. Cas9 protein molecule is programmed with equimolar amounts of pre-annealed gRNA molecule and titrated from 100 pM to 1 µM. Radiolabeled DNA is added to a final concentration of 20 pM. Samples are incubated for 1 h at 37° C. and resolved at 4° C. on an 8% native polyacrylamide gel containing 1× TBE and 5 mM $MgCl_2$. Gels are dried and DNA visualized by phosphorimaging.

Repair Assays: Testing a Cas9 to Promote DNA Repair

The ability of a Cas9 system to promote DNA repair by a HDR pathway, e.g., HDR or ALT-HR, can be evaluated in a cell-based GFP assay. DNA repair by a HDR pathway is typically used to correct a gene with a mutation or undesired sequence. For this assay, a cell line carrying a non-functional GFP reporter system is used. An exogenous non-functional GFP gene, e.g., a GFP with an inactivating mutation, is delivered, e.g., by transfection, into a cell. Alternatively, the cell line carries one copy of a non-functional GFP gene integrated into the genome of the cell, e.g., by transduction. A candidate Cas9 protein molecule or nucleic acid, a gRNA that mediates binding of the Cas9 to the GFP gene to be corrected, and a template nucleic acid containing a functional, e.g., corrected GFP gene sequence, is delivered, e.g., by transfection, into the cell. An HDR-enhancer molecule is administered to the test cells, and no HDR-enhancer molecule is administered to control cells. The cells are cultured for a sufficient amount of time to allow repair and expression of the GFP gene, and GFP expression is analyzed by flow cytometry. An increase in GFP-expressing (GFP-positive) cells or an increased level of GFP signal, as compared to a control, indicates that DNA repair occurred, resulting in gene correction. GFP positive cells can be collected by cell sorting methods, and further analyzed by various sequencing methods to confirm correction of the targeted locus of the GFP gene.

The ability of a Cas9 to promote DNA repair by ALT-NHEJ can be evaluated in a cell-based GFP assay. DNA repair by the alt-NHEJ pathway is typically used to disrupt a gene and prevent expression. For this assay, a cell line carrying a functional GFP reporter system is used. An exogenous functional GFP gene, e.g., a wild-type GFP gene, is delivered, e.g., by transfection, into a cell. Alternatively, the cell line carries one copy of a functional or wild-type GFP gene integrated into the genome of the cell, e.g., by transduction. A candidate Cas9 protein molecule or nucleic acid and a gRNA that mediates binding of the Cas9 molecule to the GFP gene is delivered, e.g., by transfection, into the cell. An EPR-enhancer is administered to the test cells, and no EPR-enhancer is administered to control cells. The cells are cultured for a sufficient amount of time to allow repair and expression of the GFP gene, and GFP expression is analyzed by flow cytometry. A decrease in GFP-expressing cells or a decrease in the level of GFP signal, as compared to a control, indicates that DNA repair occurred, resulting in gene disruption. GFP negative cells can be collected by cell sorting methods, and further analyzed by various sequencing methods to confirm disruption of the targeted locus of the GFP gene.

Differential Scanning Flourimetry (DSF)

The thermostability of Cas9 molecule-gRNA ribonucleoprotein (RNP) complexes, e.g., a Cas9 molecule-gRNA RNP complex, can be measured via DSF. This technique measures the thermostability of a protein, which can increase under favorable conditions such as the addition of a binding molecule, e.g., a gRNA.

The assay is performed using two different protocols, one to test the best stoichiometric ratio of gRNA:Cas9 protein and another to determine the best solution conditions for RNP formation.

To determine the best solution to form RNP complexes, a 2 uM solution of Cas9 in water+10× SYPRO Orange® (Life Technologies cat #S-6650) and dispensed into a 384 well plate. An equimolar amount of gRNA diluted in solutions with varied pH and salt is then added. After incubating at room temperature for 10 min and brief centrifugation to remove any bubbles, a Bio-Rad CFX384™ Real-Time System C1000 Touch™ Thermal Cycler with the Bio-Rad CFX Manager software is used to run a gradient from 20° C. to 90° C. with a 1° C. increase in temperature every 10 seconds.

The second assay consists of mixing various concentrations of gRNA with 2 uM Cas9 molecule in optimal buffer from the assay above and incubating at RT for 10 min in a 384 well plate. An equal volume of optimal buffer+10× SYPRO Orange® (Life Techonologies cat #S-6650) is added and the plate sealed with Microseal® B adhesive (MSB-1001). Following brief centrifugation to remove any bubbles, a Bio-Rad CFX384™ Real-Time System C1000 Touch™ Thermal Cycler with the Bio-Rad CFX Manager software is used to run a gradient from 20° C. to 90° C. with a 1° C. increase in temperature every 10 seconds.

Resection Assay: Testing a Cas9 to Promote Resection

The ability of a Cas9 to promote resection can be evaluated by measuring the levels of single stranded DNA at specific double strand break sites in human cells using quantitative methods (as described in Zhou et al., Nucleic Acids Res, 2014, 42(3):e19). In this assay, a cell line is delivered, e.g., by transfection, a candidate Cas9 or a candidate Cas9 fusion protein. The cells are cultured for a sufficient amount of time to allow nuclease activity and resection to occur. Genomic DNA is carefully extracted using a method in which cells are embedded in low-gelling point agar that protects the DNA from shearing and damage during extraction. The genomic DNA is digested with a restriction enzyme that selectively cuts double-stranded DNA. Primers for quantitative PCR that span up to 5 kb of the double strand break site are designed. The results from the PCR reaction show the levels of single strand DNA detected at each of the primer positions. Thus, the length and the level of resection promoted by the candidate Cas9 or Cas9 fusion protein can be determined from this assay.

Other qualitative assays for identifying the occurrence of resection include the detection of proteins or protein complexes that bind to single-stranded DNA after resection has occurred, e.g., RPA foci, Rad51 foci, or BrDU detection by immunofluorescence. Antibodies for RPA protein and Rad51 are known in the art.

V. Genome Editing Approaches

Mutations may be corrected, and undesirable nucleic acid sequences may be cleaved, using one of the approaches discussed herein. In an embodiment, a mutation in a target nucleic acid is corrected by homology directed repair (HDR) using a template nucleic acid (see Section V.1).

V.1 HDR Repair and Template Nucleic Acids

As described herein, nuclease-induced homology directed repair (HDR) can be used to alter a target sequence and correct (e.g., repair or edit) a mutation in the genome. While not wishing to be bound by theory, it is believed that alteration of the target sequence occurs by homology-directed repair (HDR) with a donor template or template nucleic acid. For example, the donor template or the template nucleic acid provides for alteration of the target position. It is contemplated that a plasmid donor can be used as a template for homologous recombination. In an embodiment where a double-stranded template nucleic acid is used, the target position is altered by HDR. It is further contemplated that a single stranded donor template can be used as a template for alteration of the target position by alternate methods of homology directed repair (e.g., HR, alt-HR, and/or single strand annealing) between the target position and the donor template. Donor template-effected alteration of a target position depends on target sequence cleavage by a Cas9 molecule. Cleavage by Cas9 can comprise a nick, a double strand break, or two single strand breaks, e.g., one on each strand of the target nucleic acid.

In an embodiment, a mutation can be corrected by either a single double-strand break or two single strand breaks. In an embodiment, a mutation can be corrected by (1) a single double-strand break, (2) two single strand breaks, (3) two double strand breaks with a break occurring on each side of the target position, (4) one double strand break and two single strand breaks with the double strand break and two single strand breaks occurring on each side of the target position (5) four single strand breaks with a pair of single strand breaks occurring on each side of the target position, or (6) one single strand break. In an embodiment where one single-stranded break is used, the target position can be altered by alternative HDR.

In an embodiment where a single-stranded template nucleic acid is used, the target position can be altered by alternative HDR.

Donor template-effected alteration of a target position depends on cleavage by a Cas9 molecule. Cleavage by Cas9 can comprise a nick, a double strand break, or two single strand breaks, e.g., one on each strand of the target nucleic acid. After introduction of the breaks on the target nucleic acid, resection occurs at the break ends resulting in single stranded overhanging DNA regions.

Methods of promoting HDR pathways, e.g., SSA, alt-HR, and/or HR, are described herein in Section VI.

Additional details on template nucleic acids are provided in Section IV entitled "Template nucleic acids" in International Application PCT/US2014/057905, Publication Number WO2015/048577.

Double Strand Break Mediated Correction

In an embodiment, double strand cleavage is effected by a Cas9 molecule having cleavage activity associated with an HNH-like domain and cleavage activity associated with a RuvC-like domain, e.g., an N-terminal RuvC-like domain, e.g., a wild type Cas9 molecule. Such embodiments require only a single gRNA. In other embodiments, dual gRNAs are required (see, for example, FIG. 2).

Single Strand Break Mediated Correction

In some embodiments, one single strand break, or nick, is effected by a Cas9 molecule having nickase activity, e.g., a Cas9 nickase as described herein. A nicked target nucleic acid can be a substrate for alt-HR.

In other embodiments, two single strand breaks, or nicks, are effected by a Cas9 molecule having nickase activity, e.g., cleavage activity associated with an HNH-like domain or cleavage activity associated with an N-terminal RuvC-like domain. Such embodiments usually require two gRNAs, one for placement of each single strand break. In an embodiment, the Cas9 molecule having nickase activity cleaves the strand to which the gRNA hybridizes, but not the strand that is complementary to the strand to which the gRNA hybridizes. In an embodiment, the Cas9 molecule having nickase activity does not cleave the strand to which the gRNA hybridizes, but rather cleaves the strand that is complementary to the strand to which the gRNA hybridizes.

In an embodiment, the nickase has HNH activity, e.g., a Cas9 molecule having the RuvC activity inactivated, e.g., a Cas9 molecule having a mutation at D10, e.g., the D10A mutation. D10A inactivates RuvC; therefore, the Cas9 nickase has (only) HNH activity and will cut on the strand to which the gRNA hybridizes (e.g., the complementary strand, which does not have the NGG PAM on it). In other embodiments, a Cas9 molecule having an H840, e.g., an H840A, mutation can be used as a nickase. H840A inactivates HNH; therefore, the Cas9 nickase has (only) RuvC activity and cuts on the non-complementary strand (e.g., the strand that has the NGG PAM and whose sequence is identical to the gRNA).

In other embodiments, a Cas9 molecule having an N863, e.g., the N863A mutation, mutation can be used as a nickase. N863A inactivates HNH therefore the Cas9 nickase has (only) RuvC activity and cuts on the non-complementary strand (the strand that has the NGG PAM and whose sequence is identical to the gRNA). In other embodiments, a Cas9 molecule having an N580, e.g., the N580A mutation, mutation can be used as a nickase. N580A inactivates HNH therefore the Cas9 nickase has (only) RuvC activity and cuts on the non-complementary strand (the strand that has the NGG PAM and whose sequence is identical to the gRNA). In an embodiment, in which a nickase and two gRNAs are used to position two single strand nicks, one nick is on the + strand and one nick is on the − strand of the target nucleic acid. The PAMs can be outwardly facing. The gRNAs can be selected such that the gRNAs are separated by, from about 0-50, 0-100, or 0-200 nucleotides. In an embodiment, there is no overlap between the target sequences that are complementary to the targeting domains of the two gRNAs. In an embodiment, the gRNAs do not overlap and are separated by as much as 50, 100, or 200 nucleotides. In an embodiment, the use of two gRNAs can increase specificity, e.g., by decreasing off-target binding (Ran et al. (2013) CELL 154: 1380-1389).

In an embodiment, a single nick can be used to induce HDR, e.g., alt-HR. It is contemplated herein that a single nick can be used to increase the ratio of HR to NHEJ at a given cleavage site. In an embodiment, a single strand break is formed in the strand of the target nucleic acid to which the targeting domain of said gRNA is complementary. In another embodiment, a single strand break is formed in the strand of the target nucleic acid other than the strand to which the targeting domain of said gRNA is complementary.

Placement of the Double Strand Break or a Single Strand Break Relative to Target Position or Other Landmark The double strand break or single strand break in one of the strands should be sufficiently close to target position such that an alteration is produced in the desired region, e.g., correction of a mutation occurs. In an embodiment, the distance is not more than 50, 100, 200, 300, 350 or 400 nucleotides. While not wishing to be bound by theory, in some embodiments, it is believed that the break should be sufficiently close to target position such that the target position is within the region that is subject to exonuclease-mediated removal during end resection. If the distance between the target position and a break is too great, the mutation or other sequence desired to be altered may not be included in the end resection and, therefore, may not be corrected, as donor sequence, either exogenously provided donor sequence or endogenous genomic donor sequence, in some embodiments is only used to correct sequence within the end resection region.

In an embodiment, the targeting domain is configured such that a cleavage event, e.g., a double strand or single strand break, is positioned within 1, 2, 3, 4, 5, 10, 15, 20, 25, 30, 35, 40, 45, 50, 60, 70, 80, 90, 100, 150 or 200 nucleotides of the region desired to be altered, e.g., a mutation. The break, e.g., a double strand or single strand break, can be positioned upstream or downstream of the region desired to be altered, e.g., a mutation. In some embodiments, a break is positioned within the region desired to be altered, e.g., within a region defined by at least two mutant nucleotides. In some embodiments, a break is positioned immediately adjacent to the region desired to be altered, e.g., immediately upstream or downstream of a mutation.

In an embodiment, a single strand break is accompanied by an additional single strand break, positioned by a second gRNA molecule, as discussed below. For example, the targeting domains bind configured such that a cleavage event, e.g., the two single strand breaks, are positioned within 1, 2, 3, 4, 5, 10, 15, 20, 25, 30, 35, 40, 45, 50, 60, 70, 80, 90, 100, 150 or 200 nucleotides of a target position. In an embodiment, the first and second gRNA molecules are configured such, that when guiding a Cas9 nickase, a single strand break will be accompanied by an additional single strand break, positioned by a second gRNA, sufficiently close to one another to result in alteration of the desired region. In an embodiment, the first and second gRNA molecules are configured such that a single strand break positioned by said second gRNA is within 10, 20, 30, 40, or 50 nucleotides of the break positioned by said first gRNA molecule, e.g., when the Cas9 is a nickase. In an embodiment, the two gRNA molecules are configured to position cuts at the same position, or within a few nucleotides of one another, on different strands, e.g., essentially mimicking a double strand break.

In an embodiment, in which a gRNA (unimolecular (or chimeric) or modular gRNA) and Cas9 nuclease induce a double strand break for the purpose of inducing HDR-mediated correction, the cleavage site is between 0-200 bp (e.g., 0-175, 0 to 150, 0 to 125, 0 to 100, 0 to 75, 0 to 50, 0 to 25, 25 to 200, 25 to 175, 25 to 150, 25 to 125, 25 to 100, 25 to 75, 25 to 50, 50 to 200, 50 to 175, 50 to 150, 50 to 125, 50 to 100, 50 to 75, 75 to 200, 75 to 175, 75 to 150, 75 to 125, 75 to 100 bp) away from the target position. In an embodiment, the cleavage site is between 0-100 bp (e.g., 0 to 75, 0 to 50, 0 to 25, 25 to 100, 25 to 75, 25 to 50, 50 to 100, 50 to 75 or 75 to 100 bp) away from the target position.

In some embodiments, one can promote HDR by using nickases to generate a break with overhangs. While not wishing to be bound by theory, the single stranded nature of the overhangs can enhance the cell's likelihood of repairing the break by HDR as opposed to, e.g., alt-NHEJ or c-NHEJ. Specifically, in some embodiments, HDR is promoted by selecting a first gRNA that targets a first nickase to a first target sequence, and a second gRNA that targets a second nickase to a second target sequence which is on the opposite DNA strand from the first target sequence and offset from the first nick.

In an embodiment, the targeting domain of a gRNA molecule is configured to position a cleavage event sufficiently far from a preselected nucleotide, e.g., the nucleotide of a coding region, such that the nucleotide is not altered. In an embodiment, the targeting domain of a gRNA molecule is configured to position an intronic cleavage event sufficiently far from an intron/exon border, or naturally occurring splice signal, to avoid alteration of the exonic sequence or unwanted splicing events. The gRNA molecule may be a first, second, third and/or fourth gRNA molecule, as described herein.

Placement of a First Break and a Second Break Relative to Each Other

In an embodiment, a double strand break can be accompanied by an additional double strand break, positioned by a second gRNA molecule, as is discussed below.

In an embodiment, a double strand break can be accompanied by two additional single strand breaks, positioned by a second gRNA molecule and a third gRNA molecule.

In an embodiment, a first and second single strand breaks can be accompanied by two additional single strand breaks positioned by a third gRNA molecule and a fourth gRNA molecule.

When two or more gRNAs are used to position two or more cleavage events, e.g., double strand or single strand breaks, in a target nucleic acid, it is contemplated that the two or more cleavage events may be made by the same or different Cas9 proteins. For example, when two gRNAs are used to position two double strand breaks, a single Cas9 nuclease may be used to create both double strand breaks. When two or more gRNAs are used to position two or more single strand breaks (nicks), a single Cas9 nickase may be used to create the two or more nicks. When two or more gRNAs are used to position at least one double strand break and at least one single strand break, two Cas9 proteins may be used, e.g., one Cas9 nuclease and one Cas9 nickase. It is contemplated that when two or more Cas9 proteins are used that the two or more Cas9 proteins may be delivered sequentially to control specificity of a double stranded versus a single strand break at the desired position in the target nucleic acid.

In some embodiments, the targeting domain of the first gRNA molecule and the targeting domain of the second gRNA molecules are complementary to opposite strands of the target nucleic acid molecule. In some embodiments, the gRNA molecule and the second gRNA molecule are configured such that the PAMs are oriented outward.

In certain embodiments, two gRNA are selected to direct Cas9-mediated cleavage at two positions that are a preselected distance from each other. In embodiments, the two points of cleavage are on opposite strands of the target nucleic acid. In some embodiments, the two cleavage points form a blunt ended break, and in other embodiments, they are offset so that the DNA ends comprise one or two overhangs (e.g., one or more 5' overhangs and/or one or more 3' overhangs). In some embodiments, each cleavage event is a nick. In embodiments, the nicks are close enough together that they form a break that is recognized by the double strand break machinery (as opposed to being recognized by, e.g., the SSBr machinery). In some embodiments, the nicks are far enough apart that they create an overhang that is a substrate for HDR, i.e., the placement of the breaks mimics a DNA substrate that has experienced some resection. For instance, in some embodiments the nicks are spaced to create an overhang that is a substrate for processive resection. In some embodiments, the two breaks are spaced within 25-65 nucleotides of each other. The two breaks may be, e.g., about 25, 30, 35, 40, 45, 50, 55, 60 or 65 nucleotides of each other. The two breaks may be, e.g., at least about 25, 30, 35, 40, 45, 50, 55, 60 or 65 nucleotides of each other. The two breaks may be, e.g., at most about 30, 35, 40, 45, 50, 55, 60 or 65 nucleotides of each other. In some embodiments, the two breaks are about 25-30, 30-35, 35-40, 40-45, 45-50, 50-55, 55-60, or 60-65 nucleotides of each other.

In some embodiments, the break that mimics a resected break comprises a 3' overhang (e.g., generated by a DSB and a nick, where the nick leaves a 3' overhang), a 5' overhang (e.g., generated by a DSB and a nick, where the nick leaves a 5' overhang), a 3' and a 5' overhang (e.g., generated by three cuts), two 3' overhangs (e.g., generated by two nicks that are offset from each other), or two 5' overhangs (e.g., generated by two nicks that are offset from each other).

In an embodiment, in which two gRNAs (independently, unimolecular (or chimeric) or modular gRNA) complexing with Cas9 nickases induce two single strand breaks for the purpose of inducing HDR-mediated correction, the closer nick is between 0-200 bp (e.g., 0-175, 0 to 150, 0 to 125, 0 to 100, 0 to 75, 0 to 50, 0 to 25, 25 to 200, 25 to 175, 25 to 150, 25 to 125, 25 to 100, 25 to 75, 25 to 50, 50 to 200, 50 to 175, 50 to 150, 50 to 125, 50 to 100, 50 to 75, 75 to 200, 75 to 175, 75 to 150, 75 to 125, 75 to 100 bp) away from the target position and the two nicks will ideally be within 25-65 bp of each other (e.g., 25 to 50, 25 to 45, 25 to 40, 25 to 35, 25 to 30, 30 to 55, 30 to 50, 30 to 45, 30 to 40, 30 to 35, 35 to 55, 35 to 50, 35 to 45, 35 to 40, 40 to 55, 40 to 50, 40 to 45 bp, 45 to 50 bp, 50 to 55 bp, 55 to 60 bp, 60 to 65 bp) and no more than 100 bp away from each other (e.g., no more than 90, 80, 70, 60, 50, 40, 30, 20, 10 or 5 bp away from each other). In an embodiment, the cleavage site is between 0-100 bp (e.g., 0 to 75, 0 to 50, 0 to 25, 25 to 100, 25 to 75, 25 to 50, 50 to 100, 50 to 75 or 75 to 100 bp) away from the target position.

In one embodiment, two gRNAs, e.g., independently, unimolecular (or chimeric) or modular gRNA, are configured to position a double-strand break on both sides of a target position. In an alternate embodiment, three gRNAs, e.g., independently, unimolecular (or chimeric) or modular gRNA, are configured to position a double strand break (i.e., one gRNA complexes with a Cas9 nuclease) and two single strand breaks or paired single strand breaks (i.e., two gRNAs complex with Cas9 nickases) on either side of the target position. In another embodiment, four gRNAs, e.g., independently, unimolecular (or chimeric) or modular gRNA, are configured to generate two pairs of single strand breaks (i.e., two pairs of two gRNAs complex with Cas9 nickases) on either side of the target position. The double strand break(s) or the closer of the two single strand nicks in a pair will ideally be within 0-500 bp of the target position (e.g., no more than 450, 400, 350, 300, 250, 200, 150, 100, 50 or 25 bp from the target position). When nickases are used, the two nicks in a pair are, in embodiments, within 25-65 bp of each other (e.g., between 25 to 55, 25 to 50, 25 to 45, 25 to 40, 25 to 35, 25 to 30, 50 to 55, 45 to 55, 40 to 55, 35 to 55, 30 to 55, 30 to 50, 35 to 50, 40 to 50, 45 to 50, 35 to 45, 40 to 45 bp, 45 to 50 bp, 50 to 55 bp, 55 to 60 bp, or 60 to 65 bp) and no more than 100 bp away from each other (e.g., no more than 90, 80, 70, 60, 50, 40, 30, 20 or 10 bp).

When two gRNAs are used to target Cas9 molecules to target DNA breaks, different combinations of Cas9 molecules are envisioned. In some embodiments, a first gRNA is used to target a first Cas9 molecule to a first target position, and a second gRNA is used to target a second Cas9 molecule to a second target position. In some embodiments, the first Cas9 molecule creates a nick on the first strand of the target nucleic acid, and the second Cas9 molecule creates a nick on the opposite strand, resulting in a double strand break (e.g., a blunt ended cut or a cut with overhangs).

Different combinations of nickases can be chosen to target one single strand break to one strand and a second single strand break to the opposite strand. When choosing a combination, one can take into account that there are nickases having one active RuvC-like domain, and nickases having one active HNH domain. In an embodiment, a RuvC-like domain cleaves the non-complementary strand of the target nucleic acid molecule. In an embodiment, an HNH-like domain cleaves a single stranded complementary domain, e.g., a complementary strand of a double stranded nucleic acid molecule. Generally, if both Cas9 molecules have the same active domain (e.g., both have an active RuvC domain or both have an active HNH domain), one will choose two gRNAs that bind to opposite strands of the target. In more detail, in some embodiments, a first gRNA is complementary with a first strand of the target nucleic acid and binds a nickase having an active RuvC-like domain and causes that nickase to cleave the strand that is non-complementary to that first gRNA, i.e., a second strand of the target nucleic acid; and a second gRNA is complementary with a second strand of the target nucleic acid and binds a nickase having an active RuvC-like domain and causes that nickase to cleave the strand that is non-complementary to that second gRNA, i.e., the first strand of the target nucleic acid. Conversely, in some embodiments, a first gRNA is complementary with a first strand of the target nucleic acid and binds a nickase having an active HNH domain and causes that nickase to cleave the strand that is complementary to that first gRNA, i.e., a first strand of the target nucleic acid; and a second gRNA is complementary with a second strand of the target nucleic acid and binds a nickase having an active HNH domain and causes that nickase to cleave the strand that is complementary to that second gRNA, i.e., the second strand of the target nucleic acid. In another arrangement, if one Cas9 molecule has an active RuvC-like domain and the other Cas9 molecule has an active HNH domain, the gRNAs for both Cas9 molecules can be complementary to the same strand of the target nucleic acid, so that the Cas9 molecule with the active RuvC-like domain will cleave the non-complementary strand and the Cas9 molecule with the HNH domain will cleave the complementary strand, resulting in a double strand break.

Exemplary Template Nucleic Acids

A template nucleic acid, as that term is used herein, refers to a nucleic acid sequence which can be used in conjunction with a Cas9 molecule and a gRNA molecule to alter the structure of a target position.

Target position, as used herein, refers to a site on a target nucleic acid (e.g., the chromosome) that is modified by a Cas9 molecule-dependent process. For example, the target position can be a modified Cas9 molecule cleavage of the target nucleic acid and template nucleic acid directed modification, e.g., correction, of the target position. In an embodiment, a target position can be a site between two nucleotides, e.g., adjacent nucleotides, on the target nucleic acid into which one or more nucleotides are added. The target position may comprise one or more nucleotides that are altered, e.g., corrected, by a template nucleic acid. In an embodiment, the target position is within a target sequence (e.g., the sequence to which the gRNA binds). In an embodiment, a target position is upstream or downstream of a target sequence (e.g., the sequence to which the gRNA binds).

In an embodiment, the target nucleic acid is modified to have the some or all of the sequence of the template nucleic acid, typically at or near cleavage site(s). In an embodiment, the template nucleic acid is single stranded. In an alternate embodiment, the template nucleic acid is double stranded. In an embodiment, the template nucleic acid is DNA, e.g., double stranded DNA. In an alternate embodiment, the template nucleic acid is single stranded DNA. In an embodiment, the template nucleic acid is encoded on the same vector backbone, e.g., AAV genome or plasmid DNA, as the Cas9 molecule and gRNA. In an embodiment, the template nucleic acid is excised from a vector backbone in vivo, e.g., it is flanked by gRNA recognition sequences. In an embodiment, the template nucleic acid comprises endogenous genomic sequence.

In an embodiment, the template nucleic acid alters the structure of the target position by participating in a homology directed repair event. In an embodiment, the template nucleic acid alters the sequence of the target position. In an embodiment, the template nucleic acid results in the incorporation of a modified, or non-naturally occurring base into the target nucleic acid.

Typically, the template sequence undergoes a breakage mediated or catalyzed recombination with the target sequence. In an embodiment, the template nucleic acid includes sequence that corresponds to a site on the target sequence that is cleaved by an eaCas9 mediated cleavage event. In an embodiment, the template nucleic acid includes sequence that corresponds to both, a first site on the target sequence that is cleaved in a first Cas9 mediated event, and a second site on the target sequence that is cleaved in a second Cas9 mediated event.

In an embodiment, the template nucleic acid can include sequence which results in an alteration in the coding sequence of a translated sequence, e.g., one which results in the substitution of one amino acid for another in a protein product, e.g., transforming a mutant allele into a wild type allele, transforming a wild type allele into a mutant allele, and/or introducing a stop codon, insertion of an amino acid residue, deletion of an amino acid residue, or a nonsense mutation.

In other embodiments, the template nucleic acid can include sequence which results in an alteration in a non-coding sequence, e.g., an alteration in an intron or in a 5' or 3' non-translated or non-transcribed region. Such alterations include an alteration in a control element, e.g., a promoter, enhancer, and an alteration in a cis-acting or trans-acting control element.

A template nucleic acid having homology with a target position in a gene, e.g., a gene described herein, can be used to alter the structure of a target sequence. The template sequence can be used to alter an unwanted structure, e.g., an unwanted or mutant nucleotide.

In an embodiment, the template nucleic acid is a single stranded nucleic acid. In another embodiment, the template nucleic acid is a double stranded nucleic acid. In some embodiments, the template nucleic acid comprises a nucleotide sequence, e.g., of one or more nucleotides, that will be added to or will template a change in the target nucleic acid.

In other embodiments, the template nucleic acid comprises a nucleotide sequence that may be used to modify the target position. In other embodiments, the template nucleic acid comprises a nucleotide sequence, e.g., of one or more nucleotides, that corresponds to wild type sequence of the target nucleic acid, e.g., of the target position.

The template nucleic acid may comprise a replacement sequence. In some embodiments, the template nucleic acid comprises a 5' homology arm. In other embodiments, the template nucleic acid comprises a 3' homology arm.

In some embodiments, the template nucleic acid is linear double stranded DNA. The length may be, e.g., about 50-500 base pairs, e.g., about 150, 160, 170, 180, 190, 200, 250, 300, 350, 400, 450, or 500 base pairs. The length may be, e.g., at least 150, 160, 170, 180, 190, 200, 250, 300, 350, 400, 450, or 500 base pairs. In some embodiments, the length is no greater than 150, 160, 170, 180, 190, 200, 250, 300, 350, 400, 450, or 500 base pairs. In some embodiments, a double stranded template nucleic acid has a length of about 160 base pairs, e.g., about 155-165, 150-170, 140-180, 130-190, 120-200, 110-210, 100-220, 90-230, or 80-240 base pairs.

The template nucleic acid can be linear single stranded DNA. In some embodiments, the template nucleic acid is (i) linear single stranded DNA that can anneal to the nicked strand of the target nucleic acid, (ii) linear single stranded DNA that can anneal to the intact strand of the target nucleic acid, (iii) linear single stranded DNA that can anneal to the transcribed strand of the target nucleic acid, (iv) linear single stranded DNA that can anneal to the non-transcribed strand of the target nucleic acid, or more than one of the preceding. The length may be, e.g., 50-500 nucleotides. The length may be, e.g., about 50-500 nucleotides. The length may be, e.g., about 150-200 nucleotides, e.g., about 150, 160, 170, 180, 190, or 200 nucleotides. The length may be, e.g., at least 150, 160, 170, 180, 190, 200, 250, 300, 350, 400, 450, or 500 nucleotides. In some embodiments, the length is no greater than 150, 160, 170, 180, 190, 200, 250, 300, 350, 400, 450, or 500 nucleotides. In some embodiments, a single stranded template nucleic acid has a length of about 160 nucleotides, e.g., about 155-165, 150-170, 140-180, 130-190, 120-200, 110-210, 100-220, 90-230, or 80-240 nucleotides.

In some embodiments, the template nucleic acid is circular double stranded DNA, e.g., a plasmid. In some embodiments, the template nucleic acid comprises about 500 to 1000 base pairs of homology on either side of the replacement sequence and/or the nick. In some embodiments, the template nucleic acid comprises about 300, 400, 500, 600, 700, 800, 900, 1000, 1500, or 2000 base pairs of homology 5' of the nick or replacement sequence, 3' of the nick or replacement sequence, or both 5' and 3' of the nick or replacement sequence. In some embodiments, the template nucleic acid comprises at least 300, 400, 500, 600, 700, 800, 900, 1000, 1500, or 2000 base pairs of homology 5' of the nick or replacement sequence, 3' of the nick or replacement sequence, or both 5' and 3' of the nick or replacement sequence. In some embodiments, the template nucleic acid comprises no more than 300, 400, 500, 600, 700, 800, 900, 1000, 1500, or 2000 base pairs of homology 5' of the nick or replacement sequence, 3' of the nick or replacement sequence, or both 5' and 3' of the nick or replacement sequence.

In some embodiments, the template nucleic acid is an adenovirus vector, e.g., an AAV vector, e.g., a ssDNA molecule of a length and sequence that allows it to be packaged in an AAV capsid. The vector may be, e.g., less than 5 kb and may contain an ITR sequence that promotes packaging into the capsid. The vector may be integration-deficient. In some embodiments, the template nucleic acid comprises about 150 to 1000 nucleotides of homology on either side of the replacement sequence and/or the nick. In some embodiments, the template nucleic acid comprises about 100, 150, 200, 300, 400, 500, 600, 700, 800, 900, 1000, 1500, or 2000 nucleotides 5' of the nick or replacement sequence, 3' of the nick or replacement sequence, or both 5' and 3' of the nick or replacement sequence. In some embodiments, the template nucleic acid comprises at least 100, 150, 200, 300, 400, 500, 600, 700, 800, 900, 1000, 1500, or 2000 nucleotides 5' of the nick or replacement sequence, 3' of the nick or replacement sequence, or both 5' and 3' of the nick or replacement sequence. In some embodiments, the template nucleic acid comprises at most 100, 150, 200, 300, 400, 500, 600, 700, 800, 900, 1000, 1500, or 2000 nucleotides 5' of the nick or replacement sequence, 3' of the nick or replacement sequence, or both 5' and 3' of the nick or replacement sequence.

In some embodiments, the template nucleic acid is a lentiviral vector, e.g., an IDLV (integration deficiency lentivirus). In some embodiments, the template nucleic acid comprises about 500 to 1000 base pairs of homology on either side of the replacement sequence and/or the nick. In some embodiments, the template nucleic acid comprises about 300, 400, 500, 600, 700, 800, 900, 1000, 1500, or 2000 base pairs of homology 5' of the nick or replacement sequence, 3' of the nick or replacement sequence, or both 5' and 3' of the nick or replacement sequence. In some embodiments, the template nucleic acid comprises at least 300, 400, 500, 600, 700, 800, 900, 1000, 1500, or 2000 base pairs of homology 5' of the nick or replacement sequence, 3' of the nick or replacement sequence, or both 5' and 3' of the nick or replacement sequence. In some embodiments, the template nucleic acid comprises no more than 300, 400, 500, 600, 700, 800, 900, 1000, 1500, or 2000 base pairs of homology 5' of the nick or replacement sequence, 3' of the nick or replacement sequence, or both 5' and 3' of the nick or replacement sequence.

In some embodiments, the template nucleic acid comprises one or more mutations, e.g., silent mutations, that prevent Cas9 molecule from recognizing and cleaving the template nucleic acid. The template nucleic acid may comprise, e.g., at least 1, 2, 3, 4, 5, 10, 20, or 30 silent mutations relative to the corresponding sequence in the genome of the cell to be altered. In some embodiments, the template nucleic acid comprises at most 2, 3, 4, 5, 10, 20, 30, or 50 silent mutations relative to the corresponding sequence in the genome of the cell to be altered.

In an embodiment, the template nucleic acid alters the structure of the target position by participating in a homology directed repair event. In an embodiment, the template nucleic acid alters the sequence of the target position. In an embodiment, the template nucleic acid results in the incorporation of a modified, or non-naturally occurring base into the target nucleic acid.

Typically, the template sequence undergoes a breakage mediated or catalyzed recombination with the target sequence. In an embodiment, the template nucleic acid includes sequence that corresponds to a site on the target sequence that is cleaved by an eaCas9 mediated cleavage event. In an embodiment, the template nucleic acid includes sequence that corresponds to both, a first site on the target sequence that is cleaved in a first Cas9 mediated event, and a second site on the target sequence that is cleaved in a second Cas9 mediated event.

In an embodiment, the template nucleic acid can include sequence which results in an alteration in the coding sequence of a translated sequence, e.g., one which results in the substitution of one amino acid for another in a protein product, e.g., transforming a mutant allele into a wild type allele, transforming a wild type allele into a mutant allele, and/or introducing a stop codon, insertion of an amino acid residue, deletion of an amino acid residue, or a nonsense mutation. In an embodiment, the template nucleic acid can include sequence which results in an alteration in a coding sequence, e.g., an alteration in an exon.

In other embodiments, the template nucleic acid can include sequence which results in an alteration in a non-coding sequence, e.g., an alteration in an intron or in a 5' or 3' non-translated or non-transcribed region. Such alterations include an alteration in a control element, e.g., a promoter, enhancer, and an alteration in a cis-acting or trans-acting control element.

A template nucleic acid having homology with a target position can be used to alter the structure of a target sequence. The template sequence can be used to alter an unwanted structure, e.g., an unwanted or mutant nucleotide.

Length of the Homology Arms

The homology arm should extend at least as far as the region in which end resection may occur, e.g., in order to allow the resected single stranded overhang to find a complementary region within the donor template. The overall length could be limited by parameters such as plasmid size or viral packaging limits. In an embodiment, a homology arm does not extend into repeated elements, e.g., ALU elements or LINE elements.

Exemplary homology arm lengths include at least 50, 100, 250, 500, 750, 1000, 2000, 3000, 4000, or 5000 nucleotides. In some embodiments, the homology arm length is 50-100, 100-250, 250-500, 500-750, 750-1000, 1000-2000, 2000-3000, 3000-4000, or 4000-5000 nucleotides.

A template nucleic acid typically comprises the following components:

[5' homology arm]-[replacement sequence]-[3' homology arm].

The homology arms provide for recombination into the chromosome, thus replacing the undesired element, e.g., a mutation or signature, with the replacement sequence. In an embodiment, the homology arms flank the most distal cleavage sites.

In an embodiment, the 3' end of the 5' homology arm is the position next to the 5' end of the replacement sequence. In an embodiment, the 5' homology arm can extend at least 10, 20, 30, 40, 50, 100, 200, 300, 400, 500, 600, 700, 800, 900, 1000, 1500, 2000, 3000, 4000, or 5000 nucleotides 5' from the 5' end of the replacement sequence.

In an embodiment, the 5' end of the 3' homology arm is the position next to the 3' end of the replacement sequence. In an embodiment, the 3' homology arm can extend at least 10, 20, 30, 40, 50, 100, 200, 300, 400, 500, 600, 700, 800, 900, 1000, 1500, 2000, 3000, 4000, or 5000 nucleotides 3' from the 3' end of the replacement sequence.

In an embodiment, to correct a mutation, the homology arms, e.g., the 5' and 3' homology arms, may each comprise about 1000 base pairs (bp) of sequence flanking the most distal gRNAs (e.g., 1000 bp of sequence on either side of the mutation).

It is contemplated herein that one or both homology arms may be shortened to avoid including certain sequence repeat elements, e.g., Alu elements or LINE elements. For example, a 5' homology arm may be shortened to avoid a sequence repeat element. In other embodiments, a 3' homology arm may be shortened to avoid a sequence repeat element. In some embodiments, both the 5' and the 3' homology arms may be shortened to avoid including certain sequence repeat elements.

It is contemplated herein that template nucleic acids for correcting a mutation may be designed for use as a single-stranded oligonucleotide, e.g., a single-stranded oligodeoxynucleotide (ssODN). When using a ssODN, 5' and 3' homology arms may range up to about 200 base pairs (bp) in length, e.g., at least 25, 50, 75, 100, 125, 150, 175, or 200 bp in length. Longer homology arms are also contemplated for ssODNs as improvements in oligonucleotide synthesis continue to be made. In some embodiments, a longer homology arm is made by a method other than chemical synthesis, e.g., by denaturing a long double stranded nucleic acid and purifying one of the strands, e.g., by affinity for a strand-specific sequence anchored to a solid substrate.

While not wishing to be bound by theory, in some embodiments HDR proceeds more efficiently when the template nucleic acid has extended homology 5' to the nick (i.e., in the 5' direction of the nicked strand) (see FIGS. 3 and 4). Accordingly, in some embodiments, the template nucleic acid has a longer homology arm and a shorter homology arm, wherein the longer homology arm can anneal 5' of the nick. In some embodiments, the arm that can anneal 5' of the nick is at least 25, 50, 75, 100, 125, 150, 175, or 200, 300, 400, 500, 600, 700, 800, 900, 1000, 1500, 2000, 3000, 4000, or 5000 nucleotides from the nick or the 5' or 3' end of the replacement sequence. In some embodiments, the arm that can anneal 5' to the nick is at least 10%, 20%, 30%, 40%, or 50% longer than the arm that can anneal 3' to the nick. In some embodiments, the arm that can anneal 5' to the nick is at least 2×, 3×, 4×, or 5× longer than the arm that can anneal 3' to the nick. Depending on whether a ssDNA template can anneal to the intact strand or the nicked strand, the homology arm that anneals 5' to the nick may be at the 5' end of the ssDNA template or the 3' end of the ssDNA template, respectively.

Similarly, in some embodiments, the template nucleic acid has a 5' homology arm, a replacement sequence, and a 3' homology arm, such that the template nucleic acid has extended homology to the 5' of the nick. For example, the 5' homology arm and 3' homology arm may be substantially the same length, but the replacement sequence may extend farther 5' of the nick than 3' of the nick. In some embodiments, the replacement sequence extends at least 10%, 20%, 30%, 40%, 50%, 2×, 3×, 4×, or 5× further to the 5' end of the nick than the 3' end of the nick.

While not wishing to be bound by theory, in some embodiments alt-HR proceeds more efficiently when the template nucleic acid is centered on the nick. Accordingly, in some embodiments, the template nucleic acid has two homology arms that are essentially the same size. For instance, the first homology arm of a template nucleic acid may have a length that is within 10%, 9%, 8%, 7%, 6%, 5%, 4%, 3%, 2%, or 1% of the second homology arm of the template nucleic acid.

Similarly, in some embodiments, the template nucleic acid has a 5' homology arm, a replacement sequence, and a 3' homology arm, such that the template nucleic acid extends substantially the same distance on either side of the nick. For example, the homology arms may have different lengths, but the replacement sequence may be selected to compensate for this. For example, the replacement sequence may extend further 5' from the nick than it does 3' of the nick, but the homology arm 5' of the nick is shorter than the homology arm 3' of the nick, to compensate. The converse is also possible, e.g., that the replacement sequence may extend further 3' from the nick than it does 5' of the nick, but the homology arm 3' of the nick is shorter than the homology arm 5' of the nick, to compensate.

Exemplary Arrangements of Linear Nucleic Acid Template Systems

In an embodiment, the nucleic acid template system is double stranded. In an embodiment, the nucleic acid template system is single stranded. In an embodiment, the nucleic acid template system comprises a single stranded portion and a double stranded portion.

In an embodiment, the template nucleic acid comprises about 50 to 500 base pairs. In an embodiment, the template nucleic acid comprises about 50 to 100, e.g., 55 to 95, 60 to 90, 65 to 85, or 70 to 80, base pairs, homology on either side of the nick and/or replacement sequence. In an embodiment, the template nucleic acid comprises about 50, 55, 60, 65, 70, 75, 80, 85, 90, 95, or 100 base pairs homology 5' of the nick or replacement sequence, 3' of the nick or replacement sequence, or both 5' and 3' of the nick or replacement sequences.

In an embodiment, the template nucleic acid comprises about 150 to 200, e.g., 155 to 195, 160 to 190, 165 to 185, or 170 to 180, base pairs homology 3' of the nick and/or replacement sequence. In an embodiment, the template nucleic acid comprises about 150, 155, 160, 165, 170, 175, 180, 185, 190, 195, or 200 base pairs homology 3' of the nick or replacement sequence. In an embodiment, the template nucleic acid comprises less than about 100, 90, 80, 70, 60, 50, 40, 30, 20, 15, or 10 base pairs homology 5' of the nick or replacement sequence.

In an embodiment, the template nucleic acid comprises about 150 to 200, e.g., 155 to 195, 160 to 190, 165 to 185, or 170 to 180, base pairs homology 5' of the nick and/or replacement sequence. In an embodiment, the template nucleic acid comprises about 150, 155, 160, 165, 170, 175, 180, 185, 190, 195, or 200 base pairs homology 5' of the nick or replacement sequence. In an embodiment, the template nucleic acid comprises less than about 100, 90, 80, 70, 60, 50, 40, 30, 20, 15, or 10 base pairs homology 3' of the nick or replacement sequence.

Exemplary Arrangements of Circular Nucleic Acid Template Systems

In an embodiment, the nucleic acid template system is double stranded. In an embodiment, the nucleic acid template system is double stranded comprises a single stranded portion and a double stranded portion. In an embodiment, the nucleic acid template system is single stranded. In one embodiment, the nucleic acid template system is a plasmid. In another embodiment, the nucleic acid template is an endogenous nucleic acid. In another embodiment, the nucleic acid template is present in an AAV or an IDLV.

In an embodiment, the template nucleic acid comprises about 500 to 2000, e.g., 700 to 1900, 800 to 1800, 900 to 1700, 900 to 1600, 1000 to 1500, 1100 to 1400, or 1200 to 1300 base pairs, homology on either side of the nick and/or replacement sequence. In an embodiment, the template nucleic acid comprises about 500, 600, 700, 800, 900, 1000, 1100, 1200, 1300, 1400, 1500, 1600, 1700, 1800, 1900, or 2000 base pairs homology 5' of the nick or replacement sequence, 3' of the nick or replacement sequence, or both 5' and 3' of the nick or replacement sequences.

In an embodiment, the template nucleic acid comprises about 500 to 2000, e.g., 700 to 1900, 800 to 1800, 900 to 1700, 900 to 1600, 1000 to 1500, 1100 to 1400, or 1200 to 1300, base pairs homology 3' of the nick and/or replacement sequence. In an embodiment, the template nucleic acid comprises about 500, 600, 700, 800, 900, 1000, 1100, 1200, 1300, 1400, 1500, 1600, 1700, 1800, 1900, or 2000 base pairs homology 3' of the nick or replacement sequence. In an embodiment, the template nucleic acid comprises less than about 500, 400, 300, 200, 100, or 50 base pairs homology 5' of the nick or replacement sequence.

In an embodiment, the template nucleic acid comprises about 500 to 2000, e.g., 700 to 1900, 800 to 1800, 900 to 1700, 900 to 1600, 1000 to 1500, 1100 to 1400, or 1200 to 1300, base pairs homology 5' of the nick and/or replacement sequence. In an embodiment, the template nucleic acid comprises about 500, 600, 700, 800, 900, 1000, 1100, 1200, 1300, 1400, 1500, 1600, 1700, 1800, 1900, or 2000 base pairs homology 5' of the nick or replacement sequence. In an embodiment, the template nucleic acid comprises less than about 500, 400, 300, 200, 100, or 50 base pairs homology 3' of the nick or replacement sequence.

Methods of Promoting Break Repair by an HDR Pathway

In another aspect, disclosed herein is a method of altering a cell, e.g., altering the structure, e.g., altering the sequence, of a target nucleic acid of a cell, comprising contacting the cell with: (a) a gRNA that targets a target position, e.g., a gRNA as described herein; (b) a Cas9 molecule, e.g., a Cas9 molecule as described herein; (c) a template nucleic acid, (d) an HDR-enhancer and optionally, (e) a second, third and/or fourth gRNA, as described herein. The methods can comprise contacting said cell with (a) and (b). The methods can comprise contacting said cell with (a), (b), and (c), and/or with (a), (b), (c) and (d).

The contacting may be performed ex vivo and the contacted cell may be returned to the subject's body after the contacting step. In other embodiments, the contacting step may be performed in vivo.

In some embodiments, contacting a cell with a Cas9 molecule comprises contacting the cell with a nucleic acid encoding the Cas9 molecule and allowing the cell to produce the Cas9 molecule. In some embodiments, contacting a cell with a gRNA comprises contacting the cell with DNA that can direct transcription of the gRNA, and allowing the cell to produce the gRNA.

In some embodiments, the method of altering a cell, as described herein, comprises acquiring knowledge of the presence of an undesired sequence in said cell, prior to the contacting step. Acquiring knowledge of the sequence of the undesired sequence in the cell may be by DNA sequencing.

In some embodiments, the contacting step of the method comprises contacting the cell with a nucleic acid, e.g., a vector, e.g., an AAV vector, that expresses or comprises at least one of (a), (b), (c), (d), and optionally (e). In some embodiments, the contacting step of the method comprises contacting the cell with a nucleic acid, e.g., a vector, e.g., an AAV vector, that expresses or comprises each of (a), (b), (c), (d), and optionally (e). In some embodiments, the contacting step of the method comprises contacting the cell with a nucleic acid, e.g., a vector, e.g., an AAV vector, that expresses or comprises two, three, or four of (a), (b), (c), (d), and optionally (e). In some embodiments, the contacting step of the method comprises contacting the cell with a nucleic acid, e.g., a vector, e.g., an AAV vector, that expresses or comprises each of (a) and (b). In another embodiment, the contacting step of the method comprises delivering to the cell a Cas9 molecule of (b), a nucleic acid which encodes a gRNA according to (a), and a template nucleic acid of (c), optionally a HDR-enhancer of (d), and optionally, a second gRNA (e)(i) (and further optionally, a third gRNA (e)(iv) and/or fourth gRNA (e)(iii)).

The contacting step of the method can comprise contacting the cell with a nucleic acid, e.g., a vector, e.g., an AAV vector, that expresses or comprises at least one of (a), (b), (c) and (d). In some embodiments, the contacting step of the method comprises contacting the cell with a nucleic acid, e.g., a vector, e.g., an AAV vector, that expresses each of (a), (b), and (c). In another embodiment, the contacting step of the method comprises delivering to the cell a Cas9 molecule of (b), a nucleic acid which encodes a gRNA (a) and a template nucleic acid of (c), optionally an HDR-enhancer of (d), and optionally, a second gRNA (e)(i) (and further optionally, a third gRNA (e)(iv) and/or fourth gRNA (e)(iii).

In an embodiment, contacting comprises contacting the cell with a nucleic acid, e.g., a vector, e.g., an AAV vector, e.g., an AAV2 vector, a modified AAV2 vector, an AAV3 vector, a modified AAV3 vector, an AAV6 vector, a modified AAV6 vector, an AAV8 vector or an AAV9 vector.

In an embodiment, contacting comprises delivering to the cell a Cas9 molecule, as a protein or an mRNA, and a nucleic acid which encodes or comprises a gRNA molecule and an HDR-enhancer molecule, and optionally a template nucleic acid and/or a second gRNA molecule.

In some embodiments, contacting comprises delivering to the cell a Cas9 molecule of (b), as a protein or an mRNA, said gRNA of (a), as an RNA, and optionally said second gRNA of (e), as an RNA, and optionally (c) as a nucleic acid. In some embodiments, the HDR-enhancer of (d) is delivered as a nucleic acid, e.g., DNA or RNA. In some embodiments, the HDR-enhancer of (d) is delivered as a functional nucleic acid such as a siRNA or RNAi oligonucleotide. In some embodiments, the HDR-enhancer of (d) is delivered as a nucleic acid, e.g., mRNA, that encodes a protein. In some embodiments, the HDR-enhancer molecule is delivered as a HDR-enhancing gRNA. In some embodiments, the HDR-enhancing gRNA is delivered in combination with an eiCas9 molecule. In some embodiments, the HDR-enhancing gRNA is delivered in combination with an eaCas9 molecule.

In some embodiment, contacting comprises delivering to the cell a gRNA of (a) as an RNA, optionally said second gRNA of (e) as an RNA, and a nucleic acid that encodes the Cas9 molecule of (b), (c) as a nucleic acid, and optionally (d) as a nucleic acid.

In some embodiments, a subject is treated by inducing a Cas9-mediated break at a target position, wherein the target position causes or exacerbates a disease or disorder, and administering a template nucleic acid and an HDR enhancer, wherein the break is repaired by HDR.

The method of treating a subject may comprise contacting the subject (or a cell from the subject) with (c) a template nucleic acid. A template nucleic acid is used when the method of treating a subject uses HDR to alter the sequence of the target nucleic acid of the subject.

In an embodiment, the method comprises acquiring knowledge of an undesired sequence in said subject, e.g., by DNA sequencing.

In an embodiment, the method comprises correcting an undesired sequence by HDR.

When the method comprises correcting an undesired sequence by HDR, a Cas9 molecule of (b), at least one guide RNA, e.g., a guide RNA of (a) and a template nucleic acid (c) can be included in the contacting step.

In an embodiment, a cell of the subject is contacted ex vivo with one or more of, e.g., all of (a), (b), (c) and (d). In an embodiment, said cell is returned to the subject's body. In an embodiment, a cell of the subject is contacted is in vivo with one or more of, e.g., all of (a), (b) (c) and (d).

In an embodiment, the cell of the subject can also be contacted in vivo by intravenous delivery of one or more of, e.g., all of (a), (b), (c), and (d).

In an embodiment, contacting comprises contacting the subject with a nucleic acid, e.g., a vector, e.g., an AAV vector, described herein, e.g., a nucleic acid that encodes or comprises at least one of, e.g., all of, (a), (b), (c), and (d).

In an embodiment, contacting comprises delivering to said subject said Cas9 molecule of (b), as a protein or mRNA, and one or more nucleic acid which encodes or comprises at least one of, e.g., all of, (a), (c), and (d).

In an embodiment, contacting comprises delivering to the subject the Cas9 molecule of (b), as a protein or mRNA, the gRNA of (a), as an RNA, a nucleic acid of (c) and optionally the HDR-enhancer of (d), as an RNA.

In an embodiment, contacting comprises delivering to the subject the gRNA of (a), as an RNA, a nucleic acid that encodes the Cas9 molecule of (b), a nucleic acid of (c), and optionally an HDR-enhancer of (d).

In an embodiment, a cell of the subject can be contacted ex vivo with (a), (b), (c) and (d). In an embodiment, said cell is returned to the subject's body.

In an embodiment, contacting comprises contacting the subject with a nucleic acid, e.g., a vector, e.g., an AAV vector, described herein, e.g., a nucleic acid that encodes or comprises at least one, e.g., all of, of (a), (b), (c), and (d).

In an embodiment, contacting comprises delivering to the subject the Cas9 molecule of (b), as a protein or mRNA, and a nucleic acid which encodes or comprises one or more of (a), (c), and (d).

In an embodiment, contacting comprises delivering to the subject the Cas9 molecule of (b), as a protein or mRNA, the gRNA of (a), as an RNA, and the template nucleic acid of (c) as a DNA.

In an embodiment, contacting comprises delivering to the subject the gRNA of (a), as an RNA, optionally said second gRNA of (e), as an RNA, and a nucleic acid that encodes the Cas9 molecule of (b), and a nucleic acid that encodes the template nucleic acid of (d).

Examples of gRNAs in Genome Editing Methods gRNA molecules as described herein can be used with Cas9 molecules that generate a double strand break or a single strand break to alter the sequence of a target nucleic acid, e.g., a target position. gRNA molecules useful in these methods are described below.

In some embodiments, the gRNA is used in making double strand breaks. In an embodiment, the gRNA, e.g., a chimeric gRNA, is configured such that it comprises one or more of the following properties:

a) it can position, e.g., when targeting a Cas9 molecule that makes double strand breaks, a double strand break (i) within 50, 100, 150 or 200 nucleotides of a target position, or (ii) sufficiently close that the target position is within the region of end resection;

b) it has a targeting domain of at least 17 nucleotides, e.g., a targeting domain of (i) 17, (ii) 18, or (iii) 20 nucleotides; and c)
(i) the proximal and tail domain, when taken together, comprise at least 15, 18, 20, 25, 30, 31, 35, 40, 45, 49, 50, or 53 nucleotides, e.g., at least 15, 18, 20, 25, 30, 31, 35, 40, 45, 49, 50, or 53 nucleotides from a naturally occurring *S. aureus, S. thermophilus*, or *N. meningitidis* tail and proximal domain, or a sequence that differs by no more than 1, 2, 3, 4, 5, 6, 7, 8, 9 or 10 nucleotides therefrom;

(ii) there are at least 15, 18, 20, 25, 30, 31, 35, 40, 45, 49, 50, or 53 nucleotides 3' to the last nucleotide of the second complementarity domain, e.g., at least 15, 18, 20, 25, 30, 31, 35, 40, 45, 49, 50, or 53 nucleotides from the corresponding sequence of a naturally occurring *S. aureus, S. thermophilus,* or *N. meningitidis* gRNA, or a sequence that differs by no more than 1, 2, 3, 4, 5, 6, 7, 8, 9 or 10 nucleotides therefrom;

(iii) there are at least 16, 19, 21, 26, 31, 32, 36, 41, 46, 50, 51, or 54 nucleotides 3' to the last nucleotide of the second complementarity domain that is complementary to its corresponding nucleotide of the first complementarity domain, e.g., at least 16, 19, 21, 26, 31, 32, 36, 41, 46, 50, 51, or 54 nucleotides from the corresponding sequence of a naturally occurring *S. aureus, S. thermophilus,* or *N. meningitidis* gRNA, or a sequence that differs by no more than 1, 2, 3, 4, 5, 6, 7, 8, 9 or 10 nucleotides therefrom;

iv) the tail domain is at least 10, 15, 20, 25, 30, 35 or 40 nucleotides in length, e.g., it comprises at least 10, 15, 20, 25, 30, 35 or 40 nucleotides from a naturally occurring *S. aureus, S. thermophilus,* or *N. meningitidis* tail domain; or a sequence that differs by no more than 1, 2, 3, 4, 5, 6, 7, 8, 9 or 10 nucleotides therefrom; or (v) the tail domain comprises 15, 20, 25, 30, 35, 40 nucleotides or all of the corresponding portions of a naturally occurring tail domain, e.g., a naturally occurring *S. aureus, S. thermophilus,* or *N. meningitidis* tail domain.

In an embodiment, the gRNA is configured such that it comprises properties: a and b(i).

In an embodiment, the gRNA is configured such that it comprises properties: a and b(ii).

In an embodiment, the gRNA is configured such that it comprises properties: a and b(iii).

In an embodiment, the gRNA is configured such that it comprises properties: a and c.

In an embodiment, the gRNA is configured such that in comprises properties: a, b, and c.

In an embodiment, the gRNA is configured such that in comprises properties: a(i), b(i), and c(i).

In an embodiment, the gRNA is configured such that in comprises properties: a(i), b(i), and c(ii).

In an embodiment, the gRNA is configured such that in comprises properties: a(i), b(iii), and c(i).

In an embodiment, the gRNA is configured such that in comprises properties: a(i), b(iii), and c(ii).

In some embodiments, the gRNA is used in making single strand breaks. In an embodiment, the gRNA, e.g., a chimeric gRNA, is configured such that it comprises one or more of the following properties:

a) it can position, e.g., when targeting a Cas9 molecule that makes single strand breaks, a single strand break (i) within 50, 100, 150 or 200 nucleotides of a target position, or (ii) sufficiently close that the target position is within the region of end resection;

b) it has a targeting domain of at least 17 nucleotides, e.g., a targeting domain of (i) 17, (ii) 18, or (iii) 20 nucleotides; and c)
(i) the proximal and tail domain, when taken together, comprise at least 15, 18, 20, 25, 30, 31, 35, 40, 45, 49, 50, or 53 nucleotides, e.g., at least 15, 18, 20, 25, 30, 31, 35, 40, 45, 49, 50, or 53 nucleotides from a naturally occurring *S. aureus, S. thermophilus,* or *N. meningitidis* tail and proximal domain, or a sequence that differs by no more than 1, 2, 3, 4, 5, 6, 7, 8, 9 or 10 nucleotides therefrom;

(ii) there are at least 15, 18, 20, 25, 30, 31, 35, 40, 45, 49, 50, or 53 nucleotides 3' to the last nucleotide of the second complementarity domain, e.g., at least 15, 18, 20, 25, 30, 31, 35, 40, 45, 49, 50, or 53 nucleotides from the corresponding sequence of a naturally occurring *S. aureus, S. thermophilus,* or *N. meningitidis* gRNA, or a sequence that differs by no more than 1, 2, 3, 4, 5, 6, 7, 8, 9 or 10 nucleotides therefrom;

(iii) there are at least 16, 19, 21, 26, 31, 32, 36, 41, 46, 50, 51, or 54 nucleotides 3' to the last nucleotide of the second complementarity domain that is complementary to its corresponding nucleotide of the first complementarity domain, e.g., at least 16, 19, 21, 26, 31, 32, 36, 41, 46, 50, 51, or 54 nucleotides from the corresponding sequence of a naturally occurring *S. aureus, S. thermophilus,* or *N. meningitidis* gRNA, or a sequence that differs by no more than 1, 2, 3, 4, 5, 6, 7, 8, 9 or 10 nucleotides therefrom;

iv) the tail domain is at least 10, 15, 20, 25, 30, 35 or 40 nucleotides in length, e.g., it comprises at least 10, 15, 20, 25, 30, 35 or 40 nucleotides from a naturally occurring *S. aureus, S. thermophilus,* or *N. meningitidis* tail domain; or, a sequence that differs by no more than 1, 2, 3, 4, 5, 6, 7, 8, 9 or 10 nucleotides therefrom; or (v) the tail domain comprises 15, 20, 25, 30, 35, 40 nucleotides or all of the corresponding portions of a naturally occurring tail domain, e.g., a naturally occurring S. *aureus, S. thermophilus,* or *N. meningitidis* tail domain.

In an embodiment, the gRNA is configured such that it comprises properties: a and b(i).

In an embodiment, the gRNA is configured such that it comprises properties: a and b(ii).

In an embodiment, the gRNA is configured such that it comprises properties: a and b(iii).

In an embodiment, the gRNA is configured such that it comprises properties: a and c.

In an embodiment, the gRNA is configured such that in comprises properties: a, b, and c.

In an embodiment, the gRNA is configured such that in comprises properties: a(i), b(i), and c(i).

In an embodiment, the gRNA is configured such that in comprises properties: a(i), b(i), and c(ii).

In an embodiment, the gRNA is configured such that in comprises properties: a(i), b(iii), and c(i).

In an embodiment, the gRNA is configured such that in comprises properties: a(i), b(iii), and c(ii).

In an embodiment, the gRNA is used with a Cas9 nickase molecule having HNH activity, e.g., a Cas9 molecule having the RuvC activity inactivated, e.g., a Cas9 molecule having a mutation at D10, e.g., the D10A mutation.

In an embodiment, the gRNA is used with a Cas9 nickase molecule having RuvC activity, e.g., a Cas9 molecule having the HNH activity inactivated, e.g., a Cas9 molecule having a mutation at H840, e.g., a H840A.

In an embodiment, a pair of gRNAs, e.g., a pair of chimeric gRNAs, comprising a first and a second gRNA, is configured such that they comprises one or more of the following properties:

a) one or both of the gRNAs can position, e.g., when targeting a Cas9 molecule that makes single strand breaks, a single strand break within (i) 50, 100, 150 or 200 nucleotides of a target position, or (ii) sufficiently close that the target position is within the region of end resection;

b) one or both have a targeting domain of at least 17 nucleotides, e.g., a targeting domain of (i) 17 or (ii) 18 nucleotides;

c) for one or both:
(i) the proximal and tail domain, when taken together, comprise at least 15, 18, 20, 25, 30, 31, 35, 40, 45, 49, 50, or 53 nucleotides, e.g., at least 15, 18, 20, 25, 30, 31, 35, 40, 45, 49, 50, or 53 nucleotides from a naturally occurring *S. aureus, S. thermophilus,* or *N. meningitidis* tail and proximal domain, or a sequence that differs by no more than 1, 2, 3, 4, 5, 6, 7, 8, 9 or 10 nucleotides therefrom;

(ii) there are at least 15, 18, 20, 25, 30, 31, 35, 40, 45, 49, 50, or 53 nucleotides 3' to the last nucleotide of the second complementarity domain, e.g., at least 15, 18, 20, 25, 30, 31, 35, 40, 45, 49, 50, or 53 nucleotides from the corresponding sequence of a naturally occurring *S. aureus*, *S. thermophilus*, or *N. meningitidis* gRNA, or a sequence that differs by no more than 1, 2, 3, 4, 5, 6, 7, 8, 9 or 10 nucleotides therefrom;

(iii) there are at least 16, 19, 21, 26, 31, 32, 36, 41, 46, 50, 51, or 54 nucleotides 3' to the last nucleotide of the second complementarity domain that is complementary to its corresponding nucleotide of the first complementarity domain, e.g., at least 16, 19, 21, 26, 31, 32, 36, 41, 46, 50, 51, or 54 nucleotides from the corresponding sequence of a naturally occurring *S. aureus, S. thermophilus*, or *N. meningitidis* gRNA, or a sequence that differs by no more than 1, 2, 3, 4, 5, 6, 7, 8, 9 or 10 nucleotides therefrom;

iv) the tail domain is at least 10, 15, 20, 25, 30, 35 or 40 nucleotides in length, e.g., it comprises at least 10, 15, 20, 25, 30, 35 or 40 nucleotides from a naturally occurring *S. aureus, S. thermophilus*, or *N. meningitidis* tail domain; or a sequence that differs by no more than 1, 2, 3, 4, 5, 6, 7, 8, 9 or 10 nucleotides therefrom; or (v) the tail domain comprises 15, 20, 25, 30, 35, 40 nucleotides or all of the corresponding portions of a naturally occurring tail domain, e.g., a naturally occurring *S. aureus, S. thermophilus*, or *N. meningitidis* tail domain;

d) the gRNAs are configured such that, when hybridized to target nucleic acid, they are separated by 0-50, 0-100, 0-200, at least 10, at least 20, at least 30 or at least 50 nucleotides;

e) the breaks made by the first gRNA and second gRNA are on different strands; and f) the PAMs are facing outwards.

In an embodiment, one or both of the gRNAs is configured such that it comprises properties: a and b(i). In an embodiment, one or both of the gRNAs is configured such that it comprises properties: a and b(ii). In an embodiment, one or both of the gRNAs is configured such that it comprises properties: a and b(iii). In an embodiment, one or both of the gRNAs configured such that it comprises properties: a and c. In an embodiment, one or both of the gRNAs is configured such that it comprises properties: a, b, and c. In an embodiment, one or both of the gRNAs is configured such that it comprises properties: a(i), b(i), and c(i). In an embodiment, one or both of the gRNAs is configured such that it comprises properties: a(i), b(i), and c(ii). In an embodiment, one or both of the gRNAs is configured such that it comprises properties: a(i), b(i), c, and d. In an embodiment, one or both of the gRNAs is configured such that it comprises properties: a(i), b(i), c, and e. In an embodiment, one or both of the gRNAs is configured such that it comprises properties: a(i), b(i), c, and f. In an embodiment, one or both of the gRNAs is configured such that it comprises properties: a(i), b(i), c, d, and e. In an embodiment, one or both of the gRNAs is configured such that it comprises properties: a(i), b(i), c, d, and f. In an embodiment, one or both of the gRNAs is configured such that it comprises properties: a(i), b(i), c, d, e, and f. In an embodiment, one or both of the gRNAs is configured such that it comprises properties: a(i), b(iii), and c(i). In an embodiment, one or both of the gRNAs is configured such that it comprises properties: a(i), b(iii), and c(ii). In an embodiment, one or both of the gRNAs is configured such that it comprises properties: a(i), b(iii), c, and d. In an embodiment, one or both of the gRNAs is configured such that it comprises properties: a(i), b(iii), c, and e. In an embodiment, one or both of the gRNAs is configured such that it comprises properties: a(i), b(iii), c, and f. In an embodiment, one or both of the gRNAs is configured such that it comprises properties: a(i), b(iii), c, d, and e. In an embodiment, one or both of the gRNAs is configured such that it comprises properties: a(i), b(iii), c, d, and f. In an embodiment, one or both of the gRNAs is configured such that it comprises properties: a(i), b(iii), c, d, e, and f.

In an embodiment, the gRNAs are used with a Cas9 nickase molecule having HNH activity, e.g., a Cas9 molecule having the RuvC activity inactivated, e.g., a Cas9 molecule having a mutation at D10, e.g., the D10A mutation.

In an embodiment, the gRNAs are used with a Cas9 nickase molecule having RuvC activity, e.g., a Cas9 molecule having the HNH activity inactivated, e.g., a Cas9 molecule having a mutation at H840, e.g., a H840A.

V.2 Non-Homologous End-Joining

Nuclease-induced non-homologous end-joining (NHEJ), for example alt-NHEJ or canonical NHEJ, can be used to target gene-specific knockouts (see FIG. 1). NHEJ, e.g., alt-NHEJ, can also be used to remove (e.g., delete) sequence in a gene of interest. In the methods for altering a cell or treating a subject by altering a cell described herein, the cell is contacted with a Cas9 molecule described herein in an amount and under conditions sufficient for NHEJ, e.g., alt-NHEJ, to occur. In an embodiment, a deletion is inserted into the nucleic acid of the cell, thereby altering the sequence of the nucleic acid of the cell. In one embodiment, Alt-NHEJ pathways include blunt EJ, MMEJ, and SD-MMEJ (see FIG. 1).

While not wishing to be bound by theory, it is believed that, in an embodiment, the genomic alterations associated with the methods described herein rely on nuclease-induced NHEJ, e.g., alt-NHEJ, and the error-prone nature of the alt-NHEJ repair pathway. NHEJ repairs a double-strand break in the DNA by joining together the two ends; however, generally, the original sequence is restored only if two compatible ends, exactly as they were formed by the double-strand break, are perfectly ligated. The DNA ends of the double-strand break are frequently the subject of enzymatic processing, resulting in the addition or removal of nucleotides, e.g., resection, at one or both strands, prior to rejoining of the ends. This results in the presence of insertion and/or deletion (indel) mutations in the DNA sequence at the site of the NHEJ repair. Two-thirds of these mutations typically alter the reading frame and, therefore, produce a non-functional protein. Additionally, mutations that maintain the reading frame, but which insert or delete a significant amount of sequence, can destroy functionality of the protein. This is locus dependent as mutations in critical functional domains are likely less tolerable than mutations in non-critical regions of the protein.

The indel mutations generated by NHEJ are unpredictable in nature; however, at a given break site certain indel sequences are favored and are over represented in the population, likely due to small regions of microhomology. The lengths of deletions can vary widely; most commonly in the 1-50 bp range, but they can easily reach greater than 100-200 bp. Insertions tend to be shorter and often include short duplications of the sequence immediately surrounding the break site. However, it is possible to obtain large insertions, and in these cases, the inserted sequence has often been traced to other regions of the genome or to plasmid DNA present in the cells.

Because NHEJ, e.g., alt-NHEJ, is a mutagenic process, it can also be used to delete small sequence motifs as long as the generation of a specific final sequence is not required. If a double-strand break is targeted near to a short target sequence, the deletion mutations caused by the NHEJ repair often span, and therefore remove, the unwanted nucleotides. For the deletion of larger DNA segments, introducing two double-strand breaks, one on each side of the sequence, can result in NHEJ between the ends with removal of the entire intervening sequence. Both of these approaches can be used to delete specific DNA sequences; however, the error-prone nature of NHEJ may still produce indel mutations at the site of repair.

Two distinct NHEJ pathways are described herein, canonical NHEJ and alternative NHEJ. Canonical NHEJ typically occurs when a double strand break has blunt, unresected ends that are ligation-competent. In some instances, minimal end processing, e.g., <5 nucleotide deletions or insertions, occurs, and the break ends are ligated thereby resulting in either correct (error-free) repair, or approximately 1-4 nucleotide insertions or deletions. Canonical NHEJ is dependent upon the KU70/80 and XRCC4/LigaseIV pathway for recognition of the break, minimal end processing, DNA synthesis, and ligation.

In contrast, alternative NHEJ is not dependent upon the KU70/80 and XRCC4/LigaseIV pathway and typically occurs when resection of more than 5 nucleotides at the break ends occurs. In some cases, resection reveals a short span, e.g., 5 to 25 nucleotides, of homologous sequence in the overhangs, also known as microhomologies. The microhomologies anneal and the intervening sequence on the single strands between the break and the annealed microhomology region is deleted. Accordingly, ALT-NHEJ typically results in longer stretches, e.g., greater than 5 nucleotides, of deleted sequence than canonical NHEJ.

Both double strand cleaving eaCas9 molecules and single strand, or nickase, eaCas9 molecules can be used in the methods and compositions described herein to generate NHEJ-mediated indels. NHEJ-mediated indels targeted to a gene, e.g., a coding region, e.g., an early coding region of a gene of interest can be used to knockout (i.e., eliminate protein expression of) a gene of interest. For example, early coding region of a gene of interest includes sequence immediately following a transcription start site, within a first exon of the coding sequence, or within 500 bp of the transcription start site (e.g., less than 500, 450, 400, 350, 300, 250, 200, 150, 100 or 50 bp).

V.3 Single-Strand Annealing

Single strand annealing (SSA) is a type of HDR-repair. Specifically, SSA repairs a double-strand break between two repeat sequences present in a target nucleic acid. Repeat sequences utilized by the SSA pathway are generally greater than 30 nucleotides in length. Resection at the break ends occurs to reveal repeat sequences on both strands of the target nucleic acid. After resection, single strand overhangs containing the repeat sequences are coated with RPA protein to prevent the repeats sequences from inappropriate annealing, e.g., to themselves. RAD52 binds to each of the repeat sequences on the overhangs and aligns the sequences to enable the annealing of the complementary repeat sequences. After annealing, the single-strand flaps of the overhangs are cleaved. New DNA synthesis fills in any gaps, and ligation restores the DNA duplex. As a result of the processing, the DNA sequence between the two repeats is deleted. The length of the deletion can depend on many factors including the location of the two repeats utilized, and the pathway or processivity of the resection.

SSA does not require a template nucleic acid to alter or correct a target nucleic acid sequence. Instead, the complementary repeat sequence is utilized.

VI. Methods of Promoting an HDR Repair Pathway

This section describes the machinery involved in different DNA repair pathways, and ways of modulating that machinery. While not wishing the theory in this section to be binding, it is believed that in many cases, inhibition of the steps or factors involved in a first DNA repair pathway increases the likelihood that a lesion will be repaired by another DNA repair pathway (e.g., HDR, such as HR, alt-HR, and/or SSA). Additional details on the DNA repair machinery are found in Ciccia and Elledge (2010) MOL. CELL 40(2): 179-204.

To begin, the relationships between different DNA damage repair pathways are described.

When a cell encounters a DSB, it follows a two-step model. The first step is the choice between canonical NHEJ (sometimes abbreviated herein as C-NHEJ) which operates on blunt DNA ends (i.e., no resection), and the initiation of resection of the DNA at the site of the DSB. After the resection is engaged, the cell faces a choice between alternative non-homologous end-joining (Alt-NHEJ, which is a class of repair pathways that includes MMEJ) and HDR (which is a class of repair pathways that includes HR, alt-HR and SSA). KU70-80 is a protein complex that has affinity for double-strand breaks and it is one of the key factors that regulates canonical NHEJ, and it suppresses both HR and alt-NHEJ. The length of resection of the DNA and the state of the cell cycle have an important role in engaging HDR versus Alt-NHEJ. Specifically, longer resection is required for HDR (hundreds of nucleotides) whereas typically short resection is needed for Alt-NHEJ; HR is active in S and G2 instead Alt-NHEJ is active throughout the cell cycle.

Each pathway is described in more detail in the following sections and tables.

TABLE VI.1

Representative Targets in Damage Repair Pathways

| Inhibition of | Will promote | Target | Compound/siRNA/gRNA/antiMiR |
|---|---|---|---|
| Inhibition of components of the DNA damage response that prevents resection at the Break promoting indirectly NHEJInhibition of components of the DNA damage response that prevents resection at the Break promoting indirectly NHEJ + B3:C51 | Increase Resection: Increase of ALT-NHEJ, HDR. Balance between ALT-NHEJ and HDR will depend if there is homology (either the sister chromatin or the donor) | 53 BP1<br><br>RIf1<br>PTIP | siRNA/gRNA<br>Dominant negative peptide<br>siRNA/gRNA<br>siRNA/gRNA |

TABLE VI.1-continued

Representative Targets in Damage Repair Pathways

| Inhibition of | Will promote | Target | Compound/siRNA/gRNA/antiMiR |
|---|---|---|---|
| Inhibition of Canonical NHEJ | Increase Resection: Increase of ALT-NHEJ, HDR. Balance between ALT-NHEJ and HDR will depend if there is homology (either the sister chromatin or the donor) | KU 70-80 DNApk | siRNA/gRNA NU7441 CC115 NK314 Wortmannin LY294002 NU 7026 IC86621 IC87102 IC87361 OK1035 SU11752 IC486241 Vaillin |
| | | Lig4 | SCR7 |
| | | XRCC4 | siRNA/gRNA |
| | | XLF | siRNA/gRNA |
| | | Artemis | siRNA/gRNA |
| Inhibition of HR | Increase cNHEJ, ALT-NHEJ/SSA and ALT-HR | BRCA2 | siRNA/gRNA |
| | | BRCA1 | siRNA/gRNA |
| | | CtIP | siRNA/gRNA dominant negative protein |
| | | EXo1 | siRNA/gRNA |
| | | DNA2 | siRNA/gRNA |
| | | MRN complex | siRNA/gRNA |
| | | MRE11 | Mirin Telomelysin Resveratrol siRNA/gRNA |
| | | Rad50 | siRNA/gRNA |
| | | Nbs1 | siRNA/gRNA |
| | | Rad51 | B02 A03 RI-1 IBR2 siRNA/gRNA |
| ALT-NHEJ | Increase of HDR: ALT-HR, SSA, HR | XRCC1 | siRNA/gRNA |
| | | Ligase I | siRNA/gRNA |
| | | Ligase III | siRNA/gRNA |
| | | Pol Theta | siRNA/gRNA |
| Inhibition of antirecombinant proteints | Increase of HDR: ALT-HR, SSA, HR | Fbh1 | siRNA/gRNA |
| | | RTEL | siRNA/gRNA |
| | | PARI | siRNA/gRNA |
| | | Rap80 | siRNA/gRNA |
| | | miRNA | miR-155-5p-antiMiR miR-155-3p-antiMiR miR-545-5p-antiMiR miR-545-3p-antiMiR miR-107-antiMiR miR-1255-A-antiMiR miR-1255-B1-antiMiR miR-1255-B2-antiMiR miR-148-5p-antiMiR miR-148-3p-antiMiR miR-193-5p-antiMiR miR-193-3p-antiMiR |
| Inhibition of Single Strand Annealing | Increase HR | Rad52 | AID 651668 siRNA/gRNA |
| | | ERCC1 | NSC 130813, siRNA/gRNA |
| | | XPF | NSC 130813 siRNA/gRNA |
| Inhibition of Single Strand Break Repair | Increase HDR | PARP | Olaparib, AZD2281, KU-0059436 Iniparib, BSI-201 BMN 673 Rucaparib, (AG014699, PF-01367338) Veliparib, ABT-888 CEP 9722 INO-1001 MK 4827 |

TABLE VI.1-continued

Representative Targets in Damage Repair Pathways

| Inhibition of | Will promote | Target | Compound/siRNA/gRNA/antiMiR |
|---|---|---|---|
| | | | BGB-290 |
| | | | E701, GPI21016 |
| | | | MP-124 |
| | | | LT-673 |
| | | | NMS-P118 |
| | | | XAV939 |
| | | | 3-aminobenzamide |
| Inhibition of MMR | Increase HDR | XRCC1 | siRNA/gRNA |
| | | Msh2 | siRNA/gRNA |
| | | | Cadmium (Cd(2+)) |
| | | Msh3 | siRNA/gRNA |
| | | Msh6 | siRNA/gRNA |
| | | | Cadmium (Cd(2+)) |
| | | Mlh1 | siRNA/gRNA |
| | | Pms2 | siRNA/gRNA |
| Chromatin modifier inhibitors | Increase HDR | Ezh2 | GSK343 |
| | | | EPZ-6438 |
| | | | GSK2816126 |
| | | | SureCN6120847 |
| | | | EPZ005687 |
| | | HDAC-Class I | Trichostatin A (TSA) |
| | | | Sodium Butyrate (NaB) |
| | | HDAC-Class II | Trichostatin A (TSA) |
| | | | Sodium Butyrate (NaB) |
| | | Setd2 | siRNA/gRNA |
| | | KDM4A/JMJD2A | siRNA/gRNA |
| Cell Cycle arrest in G2 | Increase HDR mostly HR | CDk1 | RO-3306 |
| | | | AZD 5438 |

VI.1 Homology-Directed Repair (HDR)

HDR is one of at least three repair pathways that act on double-stranded breaks (DSB). Which of the four pathways ultimately repairs a given DSB is influenced by a number of factors, including the degree of resection at the break. HDR typically acts when there has been significant resection at the DSB, forming at least one single stranded portion of DNA. The other three DSB repair pathways (canonical NHEJ, and alt-NHEJ) are discussed below. In addition to repairing DSBs, HDR (or a pathway sharing some of the same machinery) can also repair nicks when a nick is converted to a double strand break, e.g., after replication.

In some cases, the break is recognized by PARP1/2. PARP1/2 competes with Ku binding, and PARP1/2 binding favors engagement of the HDR machinery. Ku binding, in contrast, favors canonical NHEJ, as described below.

The DSB is also recognized by the MRN complex which contains MRE11, RAD50, and NBS1. MRE11 has 3' to 5' exonuclease activity and endonuclease activity. MrE11 can form a complex with RAD50, which results in the increase of exonuclease activity. The second subunit, NBS1, recruits ATM to the break. Resection at the break is initiated by the BRCA1-C complex. In this complex, CtBP-interacting protein (CtIP, also known as Retinoblastoma binding protein 8, carboxy terminal binding protein-interacting protein, or RBBP8) has endonuclease activity and interacts with BRCA1 and MRN. An initial step in the resection pathway may occur when BRCA1 displaces 53BP1-RIF1, which would otherwise push the break into the canonical NHEJ pathway. Once MRN and CtIP are assembled, endonucleolytic cleavage of the 5' ends of the DSB creates short single-stranded 3' overhangs. Next, resection enters the processive stage due to the activities of EXO1 exonuclease (which has 3' to 5' exonuclease activity), and the Dna2 endonuclease. (Dna2 possesses several enzymatic activities, including 5' to 3' exonuclease activity, ATPase activity, and helicase activity.) The helicases RECQ1, BLM, WRN, RTS, RECQ4, and RECQ5 are human helicases involved in HDR. WRN has 3' to 5' helicase activity and exonuclease activity. BLM participates in replication and repair, unwinding both single strand and double stranded DNA in the 3' to 5' direction. During repair, BLM may also be involved in 5' end resection. RecQ protein-like 4 (RECQ4 or RECQL4) has 3' to 5' helicase activity. RecQ helicase-like (RECQL, RECQ1, or RECQL1) is a member of the RecQ helicase family and has 3' to 5' helicase activity. Together, these pro-resection components favor engagement of the HDR pathway.

Resection leads to the formation of single stranded DNA regions. These regions are bound and stabilized by RPA, a heterotrimer comprising RPA1, RPA2, and RPA3. An extended single strand can be repaired by the HDR pathway as discussed in this section, such as the SSA pathway which is discussed below. In the HDR pathway, the RPA heterotrimer undergoes post-translational modification, specifically PP4-dependent dephosphorylation of RPA2 and sumoylation of RPA1. RPA binding to the ssDNA generates a signal that has multiple consequence such as activation of the DNA damage response and ultimately the engagement of BRCA2. BRCA2 then acts to promote the RPA displacement and the consequential Rad51 loading onto the resected ends. CHK1 phosphorylates RAD51, allowing it to be recruited to the break. The Rad51 filament is a key factor involved in the search for homology and in promoting the D-loop invasion.

Repair can then progress via different DNA crossover intermediates, i.e., via the synthesis-dependent strand annealing (SDSA) pathway or by formation of double Holliday junctions (dHJs). Briefly, SDSA involves a DNA polymerase which lengthens the invading strand, and the RTEL helicase. When a dHJ is formed, the following machinery participates: BLM/TOPO III which dissolves the structure, an endonuclease such as FEN1, MUS81/EME1, or SLX1/SLX4 which cleaves the structure. (The FEN1 enzyme recognizes the specific DNA structure of 5' overhanging flap structures that occur in DNA repair and replication, e.g., processes 5' ends of Okazaki fragment during lagging strand synthesis. FEN1 may also possess 5' to 3' exonuclease activity on nicked or gapped double stranded DNA.)

In some embodiments, HDR results in physical integration of the template nucleic acid (or a part of it) into the genome as part of the repair process. In other embodiments, HDR does not result in physical integration of a part of the template nucleic acid into the genome.

FA (fanconi anemia) proteins may cause cells to favor HDR over canonical NHEJ.

In some embodiments, the methods herein involve upregulating an HDR pathway(s). For instance, the methods may involve modulating (e.g., stimulating or overexpressing) a component (e.g., exactly one component, or one or more components, e.g., two or three components) of an HDR pathway, e.g., a component of Table VI.2 or VI.1(C). This component may be selected from, e.g., the group consisting of a PARP, PARP1, PARP2, MRN complex, MRE11, RAD50, NBS1, ATM, BRCA2, BRCA1, BRCA1 complex, BRCA1-C complex, BRCA1-B complex, CtIP, BRCA1, EXO1, BLM, RPA complex, RPA1, RPA2, RPA3, PP4, or RAD51. In another embodiment, the up-regulator of HDR is a dominant negative CtIP. A dominant negative CtIP promotes resection in G1 phase.

In some embodiments, the HDR-enhancer molecule is a polypeptide of Table VI.2 or VI.1(C), or a polypeptide that comprises at least 60, 70, 80, 81, 82, 83, 84, 85, 86, 87, 88, 89, 90, 91, 92, 93, 94, 95, 96, 97, 98, 99 or 100% homology with, or differs by no more than 50, 40, 30, 20, 15, 14, 13, 12, 11, 10, 9, 8, 7, 6, 5, 4, 3, 2, or 1, amino acid residues from a naturally occurring polypeptide of Table VI.2 or VI.1(C).

In some embodiments, the HDR enhancer comprises a PARP, PARP1, PARP2, member of a MRN complex, MRE11, RAD50, NBS1, BARD1, BRCA2, BRCA1, a member of a BRCA1 complex, a member of a BRCA1-C complex, a member of a BRCA1-B complex, CtIP, EXO1, BLM, RECQ1, WRN, RTS, RECQ5, RPA3, PP4, RAD51, BACH1, FANCJ, Topbp1, TOPO III, FEN1, MUS81, EME1, SLX1, SLX4, or a FA protein. In some embodiments, the HDR enhancer comprises at least 60, 70, 80, 81, 82, 83, 84, 85, 86, 87, 88, 89, 90, 91, 92, 93, 94, 95, 96, 97, 98, 99 or 100% homology with, or differs by no more than 50, 40, 30, 20, 15, 10, 9, 8, 7, 6, 5, 4, 3, 2, or 1, amino acid residues from a naturally occurring a PARP, PARP1, PARP2, a member of a MRN complex, MRE11, RAD50, NBS1, BARD1, BRCA2, BRCA1, a member of a BRCA1 complex, a member of a BRCA1-C complex, a member of a BRCA1-B complex, CtIP, EXO1, BLM, RECQ1, WRN, RTS, RECQ5, RPA3, PP4, RAD51, BACH1, FANCJ, Topbp1, TOPO III, FEN1, MUS81, EME1, SLX1, SLX4, a FA protein, or one of the proteins described herein, e.g., in Table VI.2.

In another embodiment, an HDR enhancer may be an HDR-enhancing gRNA as described herein.

TABLE VI.2

Factors that promote HDR

| Factor | Sequence |
|---|---|
| a PARP | — |
| PARP1 | MAESSDKLYRVEYAKSGRASCKKCSESIPKDSLRMAIMVQSPMFDGKVPHWYHFSCFWKVGHSIRHPDVE VDGFSELRWDDQQKVKKTAEAGGVTGKGQDGIGSKAEKTLGDFAAEYAKSNRSTCKGCMEKIEKGQVRLS KKMVDPEKPQLGMIDRWYHPGCFVKNREELGFRPEYSASQLKGFSLLATEDKEALKKQLPGVKSEGRKG DEVDGVDEVAKKKSKKEKDKDSKLEKALKAQNDLIWNIKDELKKVCSTNDLKELLIFNKQQVPSGESAIL DRVADGMVFGALLPCEECSGQLVFKSDAYYCTGDVTAWTKCMVKTQTPNRKEWVTPKEFREISYLKKLKV KKQDRIFPPETSASVAATPPPSTASAPAAVNSSASADKPLSNMKILTLGKLSRNKDEVKAMIEKLGGKLT GTANKASLCISTKKEVEKMNKKMEEVKEANIRVVSEDFLQDVSASTKSLQELFLAHILSPWGAEVKAEPV EVVAPRGKSGAALSKKSKGQVKEEGINKSEKRMKLTLKGGAAVDPDSGLEHSAHVLEKGGKVFSATLGLV DIVKGTNSYYKLQLLEDDKENRYWIFRSWGRVGTVIGSNKLEQMPSKEDAIEHFMKLYEEKTGNAWHSKN FTKYPKKFYPLEIDYGQDEEAVKKLTVNPGTKSKLPKPVQDLIKMIFDVESMKKAMVEYEIDLQKMPLGK LSKRQIQAAYSILSEVQQAVSQGSSDSQILDLSNRFYTLIPHDFGMKKPPLLNNADSVQAKVEMLDNLLD IEVAYSLLRGGSDDSSKDPIDVNYEKLKTDIKVVDRDSEEAEIIRKYVKNTHATTHNAYDLEVIDIPKIE REGECQRYKPFKQLHNRRLLWHGSRTTNFAGILSQGLRIAPPEAPVTGYMFGKGIYFADMVSKSANYCHT SQGDPIGLILLGEVALGNMYELKHASHISKLPKGKHSVKGLGKTTPDPSANISLDGVDVPLGTGISSGVN DTSLLYNEYIVYDIAQVNLKYLLKLKFNFKTSLW (poly [ADP-ribose] polymerase 1 [Homo sapiens] CCDS 1554.1) |
| PARP2 | MAARRRSTGGGRARALNESKRVNNGNTAPEDSSPAKKTRRCQRQESKKMPVAGGKANKDRTEDKQDGMP GRSWASKRVSESVKALLLKGKAPVDPECTAKVGKAHVYCEGNDVYDVMLNQINLQFNNNKYYLIQLLEDD AQRNFSVWMRWGRVGKMGQHSLVACSGNLNKAKEIFQKKFLDKTKNNWEDREKFEKVPGKYDMLQMDYAT NTQDEEETKKEESLKSPLKPESQLDLRVQELIKLICNVQAMEEMMMEMKYNTKKAPLGKLTVAQIKAGYQ SLKKIEDCIRAGQHGRALMEACNEFYTRIPHDFGLRTPPLIRTQKELSEKIQLLEALGDIEIAIKLVKTE LQSPEHPLDQHYRNLHCALRPLDHESYEFKVISQYLQSTHAPTHSDYTMTLLDLFEVEKDGEKEAFREDL HNRMLLWHGSRMSNWVGILSHGLRIAPPEAPITGYMFGKGIYFADMSSKSANYCFASRLKNTGLLLLSEV ALGQCNELLEANPKAEGLLQGKHSTKGLGKMAPSSAHFVTLNGSTVPLGPASDTGILNPDGYTLNYNEYI VYNPNQVRMRYLLKVQFNFLQLW (poly [ADP-ribose] polymerase 2 isoform 2 [Homo sapiens] CCDS 41910.1) MAARRRSTGGGRARALNESKRVNNGNTAPEDSSPAKKTRRCQRQESKKMPVAGGKANKDRTEDKQDESV KALLLKGKAPVDPECTAKVGKAHVYCEGNDVYDVMLNQTNLQFNNNKYYLIQLLEDDAQRNFSVWMRWGR VGKMGQHSLVACSGNLNKAKEIFQKKFLDKTKNNWEDREKFEKVPGKYDMLQMDYATNTQDEEETKKEES LKSPLKPESQLDLRVQELIKLICNVQAMEEMMMEMKYNTKKAPLGKLTVAQIKAGYQSLKKIEDCIRAGQ HGRALMEACNEFYTRIPHDFGLRTPPLIRTQKELSEKIQLLEALGDIEIAIKLVKTELQSPEHPLDQHYR NLHCALRPLDHESYEFKVISQYLQSTHAPTHSDYTMTLLDLFEVEKDGEKEAFREDLHNRMLLWHGSRMS |

TABLE VI.2-continued

Factors that promote HDR

| Factor | Sequence |
|---|---|
| | NWVGILSHGLRIAPPEAPITGYMFGKGIYFADMSSKSANYCFASRLKNTGLLLLSEVALGQCNELLEANP<br>KAEGLLQGKHSTKGLGKMAPSSAHFVTLNGSTVPLGPASDTGILNPDGYTLNYNEYIVYNPNQVRMRYLL<br>KVQFNFLQLW (poly [ADP-ribose] polymerase 2 isoform 1 [Homo sapiens]<br>CCDS 45077.1) |
| MRN complex | — |
| MRE11 | MSTADALDDENTFKILVATDIHLGFMEKDAVRGNDTFVTLDEILRLAQENEVDFILLGGD<br>LFHENKPSRKTLHTCLELLRKYCMGDRPVQFEILSDQSVNFGFSKFPWVNYQDGNLNISI<br>PVFSIHGNHDDPTGADALCALDILSCAGFVNHFGRSMSVEKIDISPVLLQKGSTKIALYG<br>LGSIPDERLYRMFVNKKVTMLRPKEDENSWFNLFVIHQNRSKHGSTNFIPEQFLDDFIDL<br>VIWGHEHECKIAPTKNEQQLFYISQPGSSVVTSLSPGEAVKKHVGLLRIKGRKMNMHKIP<br>LHTVRQFFMEDIVLANHPDIFNPDNPKVTQAIQSFCLEKIEEMLENAERERLGNSHQPEK<br>PLVRLRVDYSGGFEPFSVLRFSQKFVDRVANPKDIIHFFRHREQKEKTGEEINFGKLITK<br>PSEGTTLRVEDLVKQYFQTAEKNVQLSLLTERGMGEAVQEFVDKEEKDAIEELVKYQLEK<br>TQRFLKERHIDALEDKIDEEVRRFRETRQKNTNEEDDEVREAMTRARALRSQSEESASAF<br>SADDLMSIDLAEQMANDSDDSISAATNKGRGRGRGRRGGRGQNSASRGGSQRGRAFKSTR<br>QQPSRNVTTKNYSEVIEVDESDVEEDIFPTTSKTDQRWSSTSSSKIMSQSQVSKGVDFES<br>SEDDDDDPFMNTSSLRRNRR (Mre11-isoform 2 CCDS 8298.1)<br>MSTADALDDENTFKILVATDIHLGFMEKDAVRGNDTFVTLDEILRLAQENEVDFILLGGD<br>LFHENKPSRKTLHTCLELLRKYCMGDRPVQFEILSDQSVNFGFSKFPWVNYQDGNLNISI<br>PVFSIHGNHDDPTGADALCALDILSCAGFVNHFGRSMSVEKIDISPVLLQKGSTKIALYG<br>LGSIPDERLYRMFVNKKVTMLRPKEDENSWFNLFVIHQNRSKHGSTNFIPEQFLDDFIDL<br>VIWGHEHECKIAPTKNEQQLFYISQPGSSVVTSLSPGEAVKKHVGLLRIKGRKMNMHKIP<br>LHTVRQFFMEDIVLANHPDIFNPDNPKVTQAIQSFCLEKIEEMLENAERERLGNSHQPEK<br>PLVRLRVDYSGGFEPFSVLRFSQKFVDRVANPKDIIHFFRHREQKEKTGEEINFGKLITK<br>PSEGTTLRVEDLVKQYFQTAEKNVQLSLLTERGMGEAVQEFVDKEEKDAIEELVKYQLEK<br>TQRFLKERHIDALEDKIDEEVRRFRETRQKNTNEEDDEVREAMTRARALRSQSEESASAF<br>SADDLMSIDLAEQMANDSDDSISAATNKGRGRGRGRRGGRGQNSASRGGSQRGRADTGLE<br>TSTRSRNSKTAVSASRNMSIIDAFKSTRQQPSRNVTTKNYSEVIEVDESDVEEDIFPTTS<br>KTDQRWSSTSSSKIMSQSQVSKGVDFESSEDDDDDPFMNTSSLRRNRR (Mre11-isoform 1<br>CCDS8299.1) |
| RAD50 | MSRIEKMSILGVRSFGIEDKDKQIITFFSPLTILVGPNGAGKTTIIECLKYICTGDFPPGTKGNTFVHDP<br>KVAQETDVRAQIRLQFRDVNGELIAVQRSMVCTQKSKKTEFKTLEGVITRTKHGEKVSLSSKCAEIDREM<br>ISSLGVSKAVLNNVIFCHQEDSNWPLSEGKALKQKFDEIFSATRYIKALETLRQVRQTQGQKVKEYQMEL<br>KYLKQYKEKACEIRDQITSKEAQLTSSKEIVKSYENELDPLKNRLKEIEHNLSKIMKLDNEIKALDSRKK<br>QMEKDNSELEEKMEKVFQGTDEQLNDLYHNHQRTVREKERKLVDCHRELEKLKNESRLLNQEKSELLVEQ<br>GRLQLQADRHQEHIRARDSLIQSLATQLELDGFERGPFSERQIKNFHKLVREROEGEAKTANQLMNDFAE<br>KETLKQKQIDEIRDKKTGLGRIIELKSEILSKKQNELKNVKYELQQLEGSSDRILELDQELIKAERELSK<br>AEKNSNVETLKMEVISLQNEKADLDRTLRKLDQEMEQLNHHTTTRTQMEMLTKDKADKDEQIRKIKSRHS<br>DELTSLLGYFPNKKQLEDWLHSKSKEINQTRDRLAKLNKELASSEQNKNHINNELKRKEEQLSSYEDKLF<br>DVCGSQDFESDLDRLKEEIEKSSKQRAMLAGATAVYSQFITQLTDENQSCCPVCQRVFQTEAELQEVISD<br>LQSKLRLAPDKLKSTESELKKKEKRRDEMLGLVPMRQSIIDLKEKEIPELRNKLQNVNRDIQRLKNDIEE<br>QETLLGTIMPEEESAKVCLTDVTIMERFQMELKDVERKIAQQAAKLQGIDLDRTVQQVNQEKQEKQHKLD<br>TVSSKIELNRKLIQDQQEQIQHLKSTTNELKSEKLQISTNLQRRQQLEEQTVELSTEVQSLYREIKDAKE<br>QVSPLETTLEKFQQEKEELINKKNTSNKIAQDKLNDIKEKVKNIHGYMKDIENYIQDGKDDYKKQKETEL<br>NKVIAQLSECEKHKEKINEDMRLMRQDIDTQKIQERWLQDNLTLRKRNEELKEVEEERKQHLKEMGQMQV<br>LQMKSEHQKLEENIDNIKRNHNLALGRQKGYEEEIIHFKKELREPQFRDAEEKYREMMIVMRTTELVNKD<br>LDIYYKTLDQAIMKFHSMKMEEINKIIRDLWRSTYRGQDIEYIEIRSDADENVSASDKRRNYNYRVVMLK<br>GDTALDMRGRCSAGQKVLASLIIRLALAETFCLNCGIIALDEPTTNLDRENIESLAHALVEIIKSRSQQR<br>NFQLLVITHDEDFVELLGRSEYVEKFYRIKKNIDQCSEIVKCSVSSLGFNVH (Rad50 [Homo<br>sapiens], CCDS 34233.1) |
| NBS1 | MWKLLPAAGPAGGEPYRLLTGVEYVVGRKNCAILIENDQSISRNHAVLTANFSVTNLSQTDEIPVLTLKD<br>NSKYGTFVNEEKMQNGFSRTLKSGDGITFGVFGSKFRIEYEPLVACSSCLDVSGKTALNQAILQLGGFTV<br>NNWTEECTHLVMVSVKVTIKTICALICGRPIVKPEYFTEFLKAVESKKQPPQIESFYPPLDEPSIGSKNV<br>DLSGRQERKQIFKGKTFIFLNAKQHKKLSSAVVFGGGEARLITEENEEEHNFFLAPGTCVVDTGITNSQT<br>LIPDCQKKWIQSIMDMLQRQGLRPIPEAEIGLAVIFMTTKNYCDPQGHPSTGLKTTTPGPSLSQGVSVDE<br>KLMPSAPVNTTTYVADTESEQADTWDLSERPKEIKVSKMEQKFRMLSQDAPTVKESCKTSSNNNSMVSNT<br>LAKMRIPNYQLSPTKLPSINKSKDRASQQQQTNSIRNYFQPSTKKRERDEENQEMSSCKSARIETSCSLL<br>EQTQPATPSLWKNKEQHLSENEPVDTNSDNNLFTDTDLKSIVKNSASKSHAAEKLRSNKKREMDDVAIED<br>EVLEQLFKDTKPELEIDVKVQKQEEDVNVRKRPRMDIETNDTFSDEAVPESSKISQENEIGKKRELKEDS<br>LWSAKEISNNDKLQDDSEMLPKKLLLTEFRSLVIKNSTSRNPSGINDDYGQLKNFKKFKKVTYPGAGKLP<br>HIIGGSDLIAHHARKNTELEEWLRQEMEVQNQHAKEESLADDLFRYNPYLKRRR (NBS1 [Homo<br>sapiens], CCDS 6249.1) |
| BARD1 | MPDNRQPRNRQPRIRSGNEPRSAPAMEPDGRGAWAHSRAALDRLEKLLRCSRCTNILREPVCLGGCEHIF<br>CSNCVSDCIGTGCPVCYTPAWIQDLKINRQLDSMIQLCSKLRNLLHDNELSDLKEDKPRKSLFNDAGNKK<br>NSIKMWFSPRSKKVRYVVSKASVQTPAIKKDASAQQDSYEFVSPSPPADVSERAKKASARSGKKQKKKT<br>LAEINQKWNLEAEKEDGEFDSKEESKQKLVSFCSQPSVISSPQINGEIDLLASGSLTESECFGSLTEVSL<br>PLAEQIESPDTKSRNEVVTPEKVCKNYLTSKKSLPENNGKRGHHNRLSSPISKRCRTSILSTSGDFVKQ<br>TVPSENIPLPECSSPPSCKRKVGGTSGRKNSNMSDEFISLSPGTPPSTLSSSSYRRVMSSPSAMKLLPNM<br>AVKRNHRGETLLHIASIKGDIPSVEYLLQNGSDPNVKDHAGWTPLHEACNHGHLKVVELLLQHKALVNTT<br>GYQNDSPLHDAAKNGHVDIVKLLLSYGASRNAVNIFGLRPVDYTDDESMKSLLLLPEKNESSSASHCSVM<br>NTGQRRDGPLVLIGSGLSSEQQKMLSELAVILKAKKYTEFDSTVTHVVVPGDAVQSTLKCMLGILNGCWI |

TABLE VI.2-continued

Factors that promote HDR

| Factor | Sequence |
|---|---|
|  | LKFEWVKACLRRKVCEQEEKYEIPEGPRRSRLNREQLLPKLFDGCYFYLWGTFKHHPKDNLIKLVTAGGG QILSRKPKPDSDVTQTINTVAYHARPDSDQRFCTQYIIYEDLCNYHPERVRQGKVWKAPSSWFIDCVMSF ELLPLDS (BRCA1-associated RING domain protein 1 isoform 1 [Homo sapiens] CCDS 2397.1)<br>MPDNRQPRNRQPRIRSGNEPRSAPAMEPDGRGAWAHSRAALDRLEKLLRCSRCNCVSDCIGTGCPVCYTP AWIQDLKINRQLDSMIQLCSKLRNLLHDNELSDLKEDKPRKSLFNDAGNKKNSIKMWFSPRSKKVRYVVS KASVQTQPAIKKDASAQQDSYEFVSPSPPADVSERAKKASARSGKKQKKKTLAEINQKWNLEAEKEDGEF DSKEESKQKLVSFCSQPSVISSPQINGEIDLLASGSLTESECFGSLIEVSLPLAEQIESPDTKSRNEVVT PEKVCKNYLTSKKSLPLENNGKRGHHNRLSSPISKRCRTSILSTSGDFVKQTVPSENIPLPECSSPPSCK RKVGGTSGRKNSNMSDEFISLSPGTPPSTLSSSSYRRVMSSPSAMKLLPNMAVKRNHRGETLLHIASIKG DIPSVEYLLQNGSDPNVKDHAGWTPLHEACNHGHLKVVELLLQHKALVNTTGYQNDSPLHDAAKNGHVDI VKLLLSYGASRNAVNIFGLRPVDYTDDESMKSLLLLPEKNESSSASHCSVMNTGQRRDGPLVLIGSGLSS EQQKMLSELAVILKAKKYTEFDSTVIHVVVPGDAVQSTLKCMLGILNGCWILKFEWVKACLRRKVCEQEE KYEIPEGPRRSRLNREQLLPKLFDGCYFYLWGTFKHHPKDNLIKLVTAGGGQILSRKPKPDSDVTQTINT VAYHARPDSDQRFCTQYIIYEDLCNYHPERVRQGKVWKAPSSWFIDCVMSFELLPLDS (BRCA1-associated RING domain protein 1 isoform 2 [Homo sapiens] CCDS 74646.1)<br>MPDNRQPRNRQPRIRSGNEPRSAPAMEPDGRGAWAHSRAALDRLEKLLRCSRCINILREPVCLGGCEHIF CSNIFGLRPVDYTDDESMKSLLLLPEKNESSSASHCSVMNTGQRRDGPLVLIGSGLSSEQQKMLSELAVI LKAKKYTEFDSTVTHVVVPGDAVQSTLKCMLGILNGCWILKFEWVKACLRRKVCEQEEKYEIPEGPRRSR LNREQLLPKLFDGCYFYLWGTFKHHPKDNLIKLVTAGGGQILSRKPKPDSDVTQTINTVAYHARPDSDQR FCTQYIIYEDLCNYHPERVRQGKVWKAPSSWFIDCVMSFELLPLDS (BRCA1-associated RING domain protein 1 isoform 2 [Homo sapiens] CCDS 74647.1)<br>MPDNRQPRNRQPRIRSGNEPRSAPAMEPDGRGAWAHSRAALDRLEKLLRCSRCNIFGLRPVDYTDDESMK SLLLLPEKNESSSASHCSVMNTGQRRDGPLVLIGSGLSSEQQKMLSELAVILKAKKYTEFDSTVTHVVVP GDAVQSTLKCMLGILNGCWILKFEWVKACLRRKVCEQEEKYEIPEGPRRSRLNREQLLPKLFDGCYFYLW GTFKHHPKDNLIKLVTAGGGQILSRKPKPDSDVTQTINTVAYHARPDSDQRFCTQYIIYEDLCNYHPERV RQGKVWKAPSSWFIDCVMSFELLPLDS (BRCA1-associated RING domain protein 1 isoform 2 [Homo sapiens] CCDS 74645.1)<br>MPDNRQPRNRQPRIRSGNEPRSAPAMEPDGRGAWAHSRAALDRLEKLLRCSRCINILREPVCLGGCEHIF CSNCVSDCIGTGCPVCYTPAWIQDLKINRQLDSMIQLCSKLRNLLHDNELSGVKACLRRKVCEQEEKYEI PEGPRRSRLNREQLLPKLFDGCYFYLWGTFKHHPKDNLIKLVTAGGGQILSRKPKPDSDVTQTINTVAYH ARPDSDQRFCTQYIIYEDLCNYHPERVRQGKVWKAPSSWFIDCVMSFELLPLDS (BRCA1-associated RING domain protein 1 isoform 2 [Homo sapiens] CCDS 74648.1) |
| BRCA2 | MPIGSKERPTFFEIFKTRCNKADLGPISLNWFEELSSEAPPYNSEPAEESEHKNNNYEPNLFKTPQRKPS YNQLASTPIIFKEQGLTLPLYQSPVKELDKFKLDLGRNVPNSRHKSLRTVKTKMDQADDVSCPLLNSCLS ESPVVLQCTHVIPQRDKSVVCGSLFHTPKFVKGRQTPKHISESLGAEVDPDMSWSSSLATPPILSSTVLI VRNEEASETVFPHDTTANVKSYFSNHDESLKKNDRFIASVTDSENTNQREAASHGFGKTSGNSFKVNSCK DHIGKSMPNVLEDEVYETVVDTSEEDSFSLCFSKCRTKNLQKVRTSKTRKKIFHEANADECEKSKNQVKE KYSFVSEVEPNDTDPLDSNVANQKPFESGSDKISKEVVPSLACEWSQLTLSGLNGAQMEKIPLLHISSCD QNISEKDLLDTENKRKKDFLTSENSLPRISSLPKSEKPLNEETVVNKRDEEQHLESHTDCILAVKQAISG TSPVASSFQGIKKSIFRIRESPKETFNASFSGHMTDPNFKKETEASESGLEIHTVCSQKEDSLCPNLIDN GSWPATTTQNSVALKNAGLISTLKKKTNKFIYAIHDETSYKGKKIPKDQKSELINCSAQFEANAFEAPLT FANADSGLLHSSVKRSCSQNDSEEPTLSLTSSFGTILRKCSRNETCSNNTVISQDLDYKEAKCNKEKLQL FITPEADSLSCLQEGQCENDPKSKKVSDIKEEVLAAACHPVQHSKVEYSDTDFQSQKSLLYDHENASTLI LTPTSKDVLSNLVMISRGKESYKMSDKLKGNNYESDVELTKNIPMEKNQDVCALNENYKNVELLPPEKYM RVASPSRKVQFNQNTNLRVIQKNQEETTSISKITVNPDSEELFSDNENNFVFQVANERNNLALGNTKELH ETDLTCVNEPIFKNSTMVLYGDTGDKQATQVSIKKDLVYVLAEENKNSVKQHIKMTLGQDLKSDISLNID KIPEKNNDYMNKWAGLLGPISNHSFGGSFRTASNKEIKLSEHNIKKSKMFFKDIEEQYPTSLACVEIVNT LALDNQKKLSKPQSINTVSAHLQSSVVVSDCKNSHITPQMLFSKQDFNSNHNLTPSQKAEITELSTILEE SGSQFEFTQFRKPSYILQKSTFEVPENQMTILKTTSEECRDADLHVIMNAPSIGQVDSSKQFEGTVEIKR KFAGLLKNDCNKSASGYLTDENEVEGRGFYSAHGTKLNVSTEALQKAVKLFSDIENISEETSAEVHPISL SSSKCHDSVVSMFKIENHNDKTVSEKNNKCQLILQNNIEMTTGTFVEEITENYKRNTENEDNKYTAASRN SHNLEFDGSDSSKNDTVCIHKDETDLLFTDQHNICLKLSGQFMKEGNTQIKEDLSDLTFLEVAKAQEACH GNTSNKEQLTATKTEQNIKDFETSDTFFQTASGKNISVAKESFNKIVNFFDQKPEELHNFSLNSELHSDI RKNKMDILSYEETDIVKHKILKESVPVGTGNQLVTFQGQPERDEKIKEPTLLGPHTASGKKVKIAKESLD KVKNLFDEKEQGTSEITSFSHQWAKTLKYREACKDLELACETIEITAAPKCKEMQNSLNNDKNLVSIETV VPPKLLSDNLCRQTENLKTSKSIFLKVKVHENVEKETAKSPATCYTNQSPYSVIENSALAFYTSCSRKTS VSQTSLLEAKKWLREGIFDGQPERINTADYVGNYLYENNSNSTIAENDKNHLSEKQDTYLSNSSMSNSYS YHSDEVYNDSGYLSKNKLDSGIEPVLKNVEDQKNTSFSKVISNVKDANAYPQTVNEDICVEELVTSSSPC KNKNAAIKLSISNSNNFEVGPPAFRIASGKIVCVSHETIKKVKDIFTDSFSKVIKENNENKSKICQTKIM AGCYEALDDSEDILHNSLDNDECSTHSHKVFADIQSEEILQHNQNMSGLEKVSKISPCDVSLETSDICKC SIGKLHKSVSSANTCGIFSTASGKSVQVSDASLQNARQVFSEIEDSTKQVFSKVLFKSNEHSDQLTREEN TAIRTPEHLISQKGFSYNVVNSSAFSGFSTASGKQVSILESSLHKVKGVLEEFDLIRTEHSLHYSPTSRQ NVSKILPRVDKRNPEHCVNSEMEKTCSKEFKLSNNLNVEGGSSENNHSIKVSPYLSQFQQDKQQLVLGTK VSLVENIHVLGKEQASPKNVKMEIGKTETFSDVPVKTNIEVCSTYSKDSENYFETEAVEIAKAFMEDDEL TDSKLPSHATHSLFTCPENEEMVLSNSRIGKRRGEPLILVGEPSIKRNLLNEFDRIIENQEKSLKASKST PDGTIKDRRLFMHHVSLEPITCVPFRTTKERQEIQNPNFTAPGQEFLSKSHLYEHLTLEKSSSNLAVSGH PFYQVSATRNEKMRHLITTGRPTKVFVPPFKTLSHFHRVEQCVRNINLEENRQKQNIDGHGSDDSKNKIN DNEIHQFKNNSNQAVATVFTKCEEEPLDLITSLQNARDIQDMRIKKKQRQRVFPQPGSLYLAKTSTLPR ISLKAAVGGQVPSACSHKQLYTYGVSKHCIKINSKNAESFQFHTEDYFGKESLWTGKGIQLADGGWLIPS NDGKAGKEEFYRALCDTPGVDPKLISRIWVYNHYRWIIWKLAAMECAFPKEFANRCLSPERVLLQLKYRY DTEIDRSRRSAIKKIMERDDTAAKTLVLCVSDIISLSANISETSSNKTSSADTQKVAIIELTDGWYAVKA QLDPPLLAVLKNGRLTVGQKIILHGAELVGSPDACTPLEAPESLMLKISANSTRPARWYTKLGFFPDPRP |

TABLE VI.2-continued

Factors that promote HDR

| Factor | Sequence |
|---|---|
| | FPLPLSSLFSDGGNVGCVDVIIQRAYPIQWMEKTSSGLYIFRNEREEEKEAAKYVEAQQKRLEALFTKIQ<br>EEFEEHEENTTKPYLPSRALTRQQVRALQDGAELYEAVKNAADPAYLEGYFSEEQLRALNNHRQMLNDKK<br>QAQIQLEIRKAMESAEQKEQGLSRDVTTVWKLRIVSYSKKEKDSVILSIWRPSSDLYSLLTEGKRYRIYH<br>LATSKSKSKSERANIQLAATKKTQYQQLPVSDEILFQIYQPREPLHFSKFLDPDFQPSCSEVDLIGFVVS<br>VVKKTGLAPFVYLSDECYNLLAIKFWIDLNEDIIKPHMLIAASNLQWRPESKSGLLTLFAGDFSVFSASP<br>KEGHFQETFNKMKNTVENIDILCNEAENKLMHILHANDPKWSTPTKDCTSGPYTAQIIPGTGNKLLMSSP<br>NCEIYYQSPLSLCMAKRKSVSTPVSAQMTSKSCKGEKEIDDQKNCKKRRALDFLSRLPLPPPVSPICTFV<br>SPAAQKAFQPPRSCGTKYETPIKKKELNSPQMTPFKKFNEISLLESNSIADEELALINTQALLSGSTGEK<br>QFISVSESTRTAPTSSEDYLRLKRRCTTSLIKEQESSQASTEECEKNKQDTITTKKYI (breast<br>cancer 2, early onset, isoform CRA_c [Homo sapiens] CCDS 9344.1) |
| BRCA1 | MDLSALRVEEVQNVINAMQKILECPICLELIKEPVSTKCDHIFCKFCMLKLLNQKKGPSQCPLCKNDITK<br>RSLQESTRFSQLVEELLKIICAFQLDTGLEYANSYNFAKKENNSPEHLKDEVSIIQSMGYRNRAKRLLQS<br>EPENPSLQETSLSVQLSNLGTVRTLRTKQRIQPQKTSVYIELGSDSSEDTVNKATYCSVGDQELLQITPQ<br>GTRDEISLDSAKKAACEFSETDVTNTEHHQPSNNDLNTTEKRAAERHPEKYQGSSVSNLHVEPCGTNTHA<br>SSLQHENSSLLLTKDRMNVEKAEFCNKSKQPGLARSQHNRWAGSKETCNDRRTPSTEKKVDLNADPLCER<br>KEWNKQKLPCSENPRDTEDVPWITLNSSIQKVNEWFSRSDELLGSDDSHDGESESNAKVADVLDVLNEVD<br>EYSGSSEKIDLLASDPHEALICKSERVHSKSVESNIEDKIFGKTYRKKASLPNLSHVTENLIIGAFVTEP<br>QIIQERPLTNKLKRKRRPTSGLHPEDFIKKADLAVQKTPEMINQGTNQTEQNGQVMNITNSGHENKTKGD<br>SIQNEKNPNPIESLEKESAFKTKAEPISSSISNMELELNIHNSKAPKKNRLRRKSSTRHIHALELVVSRN<br>LSPPNCTELQIDSCSSSEEIKKKKYNQMPVRHSRNLQLMEGKEPATGAKKSNKPNEQTSKRHDSDTFPEL<br>KLTNAPGSFTKCSNTSELKEFVNPSLPREEKEEKLETVKVSNNAEDPKDLMLSGERVLQTERSVESSSIS<br>LVPGTDYGTQESISLLEVSTLGKAKTEPNKCVSQCAAFENPKGLIHGCSKDNRNDTEGFKYPLGHEVNHS<br>RETSIEMEESELDAQYLQNTFKVSKRQSFAPFSNPGNAEEECATFSAHSGSLKKQSPKVTFECEQKEENQ<br>GKNESNIKPVQTVNITAGFPVVGQKDKPVDNAKCSIKGGSRFCLSSQFRGNETGLITPNKHGLLQNPYRI<br>PPLFPIKSFVKTKCKKNLLEENFEEHSMSPEREMGNENIPSTVSTISRNNIRENVFKEASSSNINEVGSS<br>TNEVGSSINEIGSSDENIQAELGRNRGPKLNAMLRLGVLQPEVYKQSLPGSNCKHPEIKKQEYEEVVQTV<br>NTDFSPYLISDNLEQPMGSSHASQVCSETPDDLLDDGEIKEDTSFAENDIKESSAVFSKSVQKGELSRSP<br>SPFTHTHLAQGYRRGAKKLESSEENLSSEDEELPCFQHLLFGKVNNIPSQSTRHSTVATECLSKNTEENL<br>LSLKNSLNDCSNQVILAKASQEHHLSEETKCSASLFSSQCSELEDLTANTNTQDPFLIGSSKQMRHQSES<br>QGVGLSDKELVSDDEERGTGLEENNQEEQSMDSNLGEAASGCESETSVSEDCSGLSSQSDILTTQQRDTM<br>QHNLIKLQQEMAELEAVLEQHGSQPSNSYPSIISDSSALEDLRNPEQSTSEKAVLSIQKSSEYPISQNPE<br>GLSADKFEVSADSSTSKNKEPGVERSSPSKCPSLDDRWYMHSCSGSLQNRNYPSQEELIKVVDVEEQQLE<br>ESGPHDLTETSYLPRQDLEGTPYLESGISLFSDDPESDPSEDRAPESARVGNIPSSTSALKVPQLKVAES<br>AQSPAAAHTTDTAGYNAMEESVSREKPELTASTERVNKRMSMVVSGLTPEEFMLVYKFARKHHITLTNLI<br>TEETTHVVMKTDAEFVCERTLKYFLGIAGGKWVVSYFWVIQSIKERKMLNEHDFEVRGDVVNGRNHQGPK<br>RARESQDRKIFRGLEICCYGPFTNMPTDQLEWMVQLCGASVVKELSSFTLGTVGHPIVVVQPDAWTEDNG<br>FHAIGQMCEAPVVIREWVLDSVALYQCQELDTYLIPQIPHSHY (breast cancer type 1<br>susceptibility protein isoform 1 [Homo sapiens] CCDS 11453.1)<br>MLKLLNQKKGPSQCPLCKNDITKRSLQESTRFSQLVEELLKIICAFQLDTGLEYANSYNFAKKENNSPEH<br>LKDEVSIIQSMGYRNRAKRLLQSEPENPSLQETSLSVQLSNLGTVRTLRTKQRIQPQKTSVYIELGSDSS<br>EDTVNKATYCSVGDQELLQITPQGTRDEISLDSAKKAACEFSETDVTNTEHHQPSNNDLNTTEKRAAERH<br>PEKYQGSSVSNLHVEPCGTNTHASSLQHENSSLLLTKDRMNVEKAEFCNKSKQPGLARSQHNRWAGSKET<br>CNDRRTPSTEKKVDLNADPLCERKEWNKQKLPCSENPRDTEDVPWITLNSSIQKVNEWFSRSDELLGSDD<br>SHDGESESNAKVADVLDVLNEVDEYSGSSEKIDLLASDPHEALICKSERVHSKSVESNIEDKIFGKTYRK<br>KASLPNLSHVTENLIIGAFVTEPQIIQERPLTNKLKRKRRPTSGLHPEDFIKKADLAVQKTPEMINQGTN<br>QTEQNGQVMNITNSGHENKTKGDSIQNEKNPNPIESLEKESAFKTKAEPISSSISNMELELNIHNSKAPK<br>KNRLRRKSSTRHIHALELVVSRNLSPPNCTELQIDSCSSSEEIKKKKYNQMPVRHSRNLQLMEGKEPATG<br>AKKSNKPNEQTSKRHDSDTFPELKLTNAPGSFTKCSNTSELKEFVNPSLPREEKEEKLETVKVSNNAEDP<br>KDLMLSGERVLQTERSVESSSISLVPGTDYGTQESISLLEVSTLGKAKTEPNKCVSQCAAFENPKGLIHG<br>CSKDNRNDTEGFKYPLGHEVNHSRETSIEMEESELDAQYLQNTFKVSKRQSFAPFSNPGNAEEECATFSA<br>HSGSLKKQSPKVIFECEQKEENQGKNESNIKPVQTVNITAGFPVVGQKDKPVDNAKCSIKGGSRFCLSSQ<br>FRGNETGLITPNKHGLLQNPYRIPPLFPIKSFVKTKCKKNLLEENFEEHSMSPEREMGNENIPSTVSTIS<br>RNNIRENVFKEASSSNINEVGSSTNEVGSSINEIGSSDENIQAELGRNRGPKLNAMLRLGVLQPEVYKQS<br>LPGSNCKHPEIKKQEYEEVVQTVNTDFSPYLISDNLEQPMGSSHASQVCSETPDDLLDDGEIKEDTSFAE<br>NDIKESSAVFSKSVQKGELSRSPSPFTHTHLAQGYRRGAKKLESSEENLSSEDEELPCFQHLLFGKVNNI<br>PSQSTRHSTVATECLSKNTEENLLSLKNSLNDCSNQVILAKASQEHHLSEETKCSASLFSSQCSELEDLT<br>ANTNTQDPFLIGSSKQMRHQSESQGVGLSDKELVSDDEERGTGLEENNQEEQSMDSNLGEAASGCESETS<br>VSEDCSGLSSQSDILTTQQRDTMQHNLIKLQQEMAELEAVLEQHGSQPSNSYPSIISDSSALEDLRNPEQ<br>STSEKAVLTSQKSSEYPISQNPEGLSADKFEVSADSSTSKNKEPGVERSSPSKCPSLDDRWYMHSCSGSL<br>QNRNYPSQEELIKVVDVEEQQLEESGPHDLTETSYLPRQDLEGTPYLESGISLFSDDPESDPSEDRAPES<br>ARVGNIPSSTSALKVPQLKVAESAQSPAAAHTTDTAGYNAMEESVSREKPELTASTERVNKRMSMVVSGL<br>TPEEFMLVYKFARKHHITLTNLITEETTHVVMKTDAEFVCERTLKYFLGIAGGKWVVSYFWVTQSIKERK<br>MLNEHDFEVRGDVVNGRNHQGPKRARESQDRKIFRGLEICCYGPFTNMPTDQLEWMVQLCGASVVKELSS<br>FTLGTVGHPIVVVQPDAWTEDNGFHAIGQMCEAPVVTREWVLDSVALYQCQELDTYLIPQIPHSHY<br>(breast cancer type 1 susceptibility protein isoform 2 [Homo sapiens]<br>CCDS 11459.2)<br>MDLSALRVEEVQNVINAMQKILECPICLELIKEPVSTKCDHIFCKFCMLKLLNQKKGPSQCPLCKNDITK<br>RSLQESTRFSQLVEELLKIICAFQLDTGLEYANSYNFAKKENNSPEHLKDEVSIIQSMGYRNRAKRLLQS<br>EPENPSLQETSLSVQLSNLGTVRTLRTKQRIQPQKTSVYIELGSDSSEDTVNKATYCSVGDQELLQITPQ<br>GTRDEISLDSAKKAACEFSETDVTNTEHHQPSNNDLNTTEKRAAERHPEKYQGSSVSNLHVEPCGTNTHA<br>SSLQHENSSLLLTKDRMNVEKAEFCNKSKQPGLARSQHNRWAGSKETCNDRRTPSTEKKVDLNADPLCER<br>KEWNKQKLPCSENPRDTEDVPWITLNSSIQKVNEWFSRSDELLGSDDSHDGESESNAKVADVLDVLNEVD<br>EYSGSSEKIDLLASDPHEALICKSERVHSKSVESNIEDKIFGKTYRKKASLPNLSHVTENLIIGAFVTEP<br>QIIQERPLTNKLKRKRRPTSGLHPEDFIKKADLAVQKTPEMINQGTNQTEQNGQVMNITNSGHENKTKGD<br>SIQNEKNPNPIESLEKESAFKTKAEPISSSISNMELELNIHNSKAPKKNRLRRKSSTRHIHALELVVSRN |

TABLE VI.2-continued

Factors that promote HDR

| Factor | Sequence |
|---|---|
| | LSPPNCTELQIDSCSSSEEIKKKKYNQMPVRHSRNLQLMEGKEPATGAKKSNKPNEQTSKRHDSDTFPEL
KLTNAPGSFTKCSNTSELKEFVNPSLPREEKEEKLETVKVSNNAEDPKDLMLSGERVLQTERSVESSSIS
LVPGTDYGTQESISLLEVSTLGKAKTEPNKCVSQCAAFENPKGLIHGCSKDNRNDTEGFKYPLGHEVNHS
RETSIEMEESELDAQYLQNTFKVSKRQSFAPFSNPGNAEEECATFSAHSGSLKKQSPKVTFECEQKEENQ
GKNESNIKPVQTVNITAGFPVVGQKDKPVDNAKCSIKGGSRFCLSSQFRGNETGLITPNKHGLLQNPYRI
PPLFPIKSFVKTKCKKNLLEENFEEHSMSPEREMGNENIPSTVSTISRNNIRENVFKEASSSNINEVGSS
TNEVGSSINEIGSSDENIQAELGRNRGPKLNAMLRLGVLQPEVYKQSLPGSNCKHPEIKKQEYEEVVQTV
NTDFSPYLISDNLEQPMGSSHASQVCSETPDDLLDDGEIKEDTSFAENDIKESSAVFSKSVQKGELSRSP
SPFTHTHLAQGYRRGAKKLESSEENLSSEDEELPCFQHLLFGKVNNIPSQSTRHSTVATECLSKNTEENL
LSLKNSLNDCSNQVILAKASQEHHLSEETKCSASLFSSQCSELEDLTANTNTQDPFLIGSSKQMRHQSES
QGVGLSDKELVSDDEERGTGLEENNQEEQSMDSNLGEAASGCESETSVSEDCSGLSSQSDILTTQQRDTM
QHNLIKLQQEMAELEAVLEQHGSQPSNSYPSIIDSSSALEDLRNPEQSTSEKDSHIHGQRNNSMFSKRPR
EHISVLTSQKSSEYPISQNPEGLSADKFEVSADSSTSKNKEPGVERSSPSKCPSLDDRWYMHSCSGSLQN
RNYPSQEELIKVVDVEEQQLEESGPHDLTETSYLPRQDLEGTPYLESGISLFSDDPESDPSEDRAPESAR
VGNIPSSTSALKVPQLKVAESAQSPAAAHTTDTAGYNAMEESVSREKPELTASTERVNKRMSMVVSGLTP
EEFMLVYKFARKHHITLTNLITEETTHVVMKTDAEFVCERTLKYFLGIAGGKWVVSYFWVTQSIKERKML
NEHDFEVRGDVVNGRNHQGPKRARESQDRKIFRGLEICCYGPFTNMPTDQLEWMVQLCGASVVKELSSFT
LGTGVHPIVVVQPDAWTEDNGFHAIGQMCEAPVVTREWVLDSVALYQCQELDTYLIPQIPHSHY
(breast cancer type 1 susceptibility protein isoform 2 [Homo sapiens],
CCDS 11456.2)
MDLSALRVEEVQNVINAMQKILECPICLELIKEPVSTKCDHIFCKFCMLKLLNQKKGPSQCPLCKNDITK
RSLQESTRFSQLVEELLKIICAFQLDTGLEYANSYNFAKKENNSPEHLKDEVSIIQSMGYRNRAKRLLQS
EPENPSLQETSLSVQLSNLGTVRTLRTKQRIQPQKTSVYIELGSDSSEDTVNKATYCSVGDQELLQITPQ
GTRDEISLDSAKKAACEFSETDVTNTEHHQPSNNDLNTTEKRAAERHPEKYQGEAASGCESETSVSEDCS
GLSSQSDILTIQQRDTMQHNLIKLQQEMAELEAVLEQHGSQPSNSYPSIIDSSALEDLRNPEQSTSEKV
LTSQKSSEYPISQNPEGLSADKFEVSADSSTSKNKEPGVERSSPSKCPSLDDRWYMHSCSGSLQNRNYPS
QEELIKVVDVEEQQLEESGPHDLTETSYLPRQDLEGTPYLESGISLFSDDPESDPSEDRAPESARVGNIP
SSTSALKVPQLKVAESAQSPAAAHTTDTAGYNAMEESVSREKPELTASTERVNKRMSMVVSGLIPEEFML
VYKFARKHHITLINLITEETTHVVMKTDAEFVCERTLKYFLGIAGGKWVVSYFWVIQSIKERKMLNEHDF
EVRGDVVNGRNHQGPKRARESQDRKIFRGLEICCYGPFTNMPTDQLEWMVQLCGASVVKELSSFTLGTGV
HPIVVVQPDAWTEDNGFHAIGQMCEAPVVIREWVLDSVALYQCQELDTYLIPQIPHSHY (breast
cancer type 1 susceptibility protein isoform 2 [Homo sapiens] CCDS
11454.2)
MDLSALRVEEVQNVINAMQKILECPICLELIKEPVSTKCDHIFCKFCMLKLLNQKKGPSQCPLCKNDITK
RSLQESTRFSQLVEELLKIICAFQLDTGLEYANSYNFAKKENNSPEHLKDEVSIIQSMGYRNRAKRLLQS
EPENPSLQETSLSVQLSNLGTVRTLRTKQRIQPQKTSVYIELGSDSSEDTVNKATYCSVGDQELLQITPQ
GTRDEISLDSAKKAACEFSETDVTNTEHHQPSNNDLNTTEKRAAERHPEKYQGEAASGCESETSVSEDCS
GLSSQSDILTTQQRDTMQHNLIKLQQEMAELEAVLEQHGSQPSNSYPSIIDSSALEDLRNPEQSTSEKV
LTSQKSSEYPISQNPEGLSADKFEVSADSSTSKNKEPGVERSSPSKCPSLDDRWYMHSCSGSLQNRNYPS
QEELIKVVDVEEQQLEESGPHDLTETSYLPRQDLEGTPYLESGISLFSDDPESDPSEDRAPESARVGNIP
SSTSALKVPQLKVAESAQSPAAAHTTDTAGYNAMEESVSREKPELTASTERVNKRMSMVVSGLIPEEFML
VYKFARKHHITLINLITEETTHVVMKTDAEFVCERTLKYFLGIAGGKWVVSYFWVIQSIKERKMLNEHDF
EVRGDVVNGRNHQGPKRARESQDRKIFRGLEICCYGPFTNMPTDCPPNCGCAARCLDRGQWLPCNWADV
(breast cancer type 1 susceptibility protein isoform 2 [Homo sapiens]
CCDS 11455.2) |
| BRCA1-C complex | — |
| BRCA1-B complex | — |
| CtIP | MNISGSSCGSPNSADTSSDFKDLWTKLKECHDREVQGLQVKVTKLKQERILDAQRLEEFF
TKNQQLREQQKVLHETIKVLEDRLRAGLCDRCAVTEEHMRKKQQEFENIRQQNLKLITEL
MNERNTLQEENKKLSEQLQQKIENDQQHQAAELECEEDVIPDSPITAFSFSGVNRLRRKE
NPHVRYIEQTHIKLEHSVCANEMRKVSKSSTHPQHNPNENEILVADTYDQSQSPMAKAHG
TSSYTPDKSSFNLATVVAETLGLGVQEESETQGPMSPLGDELYHCLEGNHKKQPFEESTR
NTEDSLRFSDSTSKTPPQEELPTRVSSPVFGATSSIKSGLDLNTSLSPSLLQPGKKKHLK
TLPFSNTCISRLEKTRSKSEDSALFTHHSLGSEVNKIIIQSSNKQILINKNISESLGEQN
RTEYGKDSNTDKHLEPLKSLGGRTSKRKKTEEESEHEVSCPQASFDKENAFPFPMDNQFS
MNGDCVMDKPLDLSDRFSAIQRQEKSQGSETSKNKFRQVTLYEALKTIPKGFSSSRKASD
GNCTLPKDSPGEPCSQECIILQPLNKCSPDNKPSLQIKEENAVFKIPLRPRESLETENVL
DDIKSAGSHEPIKIQTRSDHGGCELASVLQLNPCRTGKIKSLQNNQDVSFENIQWSIDPG
ADLSQYKMDVTVIDTKDGSQSKLGGETVDMDCTLVSETVLLKMKKQEQKGEKSSNEERKM
NDSLEDMFDRTTHEEYESCLADSFSQAADEEEELSTATKKLHTHGDKQDKVKQKAFVEPY
FKGDERETSLQNFPHIEVVRKKEERRKLLGHTCKECEIYYADMPAEEREKKLASCSRHRF
RYIPPNTPENFWEVGFPSTQTCMERGYIKEDLDPCPRPKRRQPYNAIFSPKGKEQKT (CtIP-
isoform 1 CCDS 11875.1)
MNISGSSCGSPNSADTSSDFKDLWTKLKECHDREVQGLQVKVTKLKQERILDAQRLEEFF
TKNQQLREQQKVLHETIKVLEDRLRAGLCDRCAVTEEHMRKKQQEFENIRQQNLKLITEL
MNERNTLQEENKKLSEQLQQKIENDQQHQAAELECEEDVIPDSPITAFSFSGVNRLRRKE
NPHVRYIEQTHTKLEHSVCANEMRKVSKSSTHPQHNPNENEILVADTYDQSQSPMAKAHG
TSSYTPDKSSFNLATVVAETLGLGVQEESETQGPMSPLGDELYHCLEGNHKKQPFEESTR
NTEDSLRFSDSTSKTPPQEELPTRVSSPVFGATSSIKSGLDLNTSLSPSLLQPGKKKHLK
TLPFSNTCISRLEKTRSKSEDSALFTHHSLGSEVNKIIIQSSNKQILINKNISESLGEQN
RTEYGKDSNTDKHLEPLKSLGGRTSKRKKTEEESEHEVSCPQASFDKENAFPFPMDNQFS
MNGDCVMDKPLDLSDRFSAIQRQEKSQGSETSKNKFRQVTLYEALKTIPKGFSSSRKASD
GNCTLPKDSPGEPCSQECIILQPLNKCSPDNKPSLQIKEENAVFKIPLRPRESLETENVL |

TABLE VI.2-continued

Factors that promote HDR

| Factor | Sequence |
|---|---|
| | DDIKSAGSHEPIKIQTRSDHGGCELASVLQLNPCRTGKIKSLQNNQDVSFENIQWSIDPG<br>ADLSQYKMDVTVIDTKDGSQSKLGGETVDMDCTLVSETVLLKMKKQEQKGEKSSNEERKM<br>NDSLEDMFDRTTHEEYESCLADSFSQAADEEEELSTATKKLHTHGDKQDKVKQKAFVEPY<br>FKGDESIMQICQQKKEKRNWLPAQDTDSATFHPTHQRIFGKLVFLPLRLVWKEVILRKIL<br>ILVLVQKDVSLTTQYFLQKARSRRHRR (CtIP-isoform 2 CCDS 11874.1) |
| Dominant Negative CtIP<br>(S327E, T847E, or<br>S327E + T847E) | ATGAACATCTTGGGAAGCAGCTGTGGAAGCCCTAACTCTGCAGATACATCTAGTGACTTTAAGGACCTTT<br>GGACAAAACTAAAAGAATGTCATGATAGAGAAGTACAAGGTTTACAAGTAAAAGTAACCAAGCTAAAACA<br>GGAACGAATCTTAGATGCACAAAGACTAGAAGAATTCTTCACCAAAAATCAACAGCTGAGGGAACAGCAG<br>AAAGTCCTTCATGAAACCATTAAAGTTTTAGAAGATCGGTTAAGAGCAGGCTTATGTGATCGCTGTGCAG<br>TAACTGAAGAACATATGCGGAAAAAACAGCAAGAGTTTGAAAATATCCGGCAGCAGAATCTTAAACTTAT<br>TACAGAACTTATGAATGAAAGGAATACTCTACAGGAAGAAAATAAAAAGCTTTCTGAACAACTCCAGCAG<br>AAAATTGAGAATGATCAACAGCATCAAGCAGCTGAGCTTGAGGAAGACGTTATTCCAGATTCAC<br>CGATAACAGCCTTCTCATTTTCTGGCGTTAACCGGCTACGAAGAAAGGAGAACCCCCATGTCCGATACAT<br>AGAACAAACACATACTAAATTGGAGCACTCTGTGTGTGCAAATGAAATGAGAAAAGTTTCCAAGTCTTCA<br>ACTCATCCACAACATAATCCTAATGAAAATGAAATTCTAGTAGCTGACACTTATGACCAAAGTCAATCTC<br>CAATGGCCAAAGCACATGGAACAAGCAGCTATACCCCTGATAAGTCATCTTTTAATTTAGCTACAGTTGT<br>TGCTGAAACACTTGGACTTGGTGTTCAAGAAGAATCTGAAACTCAAGGTCCCATGAGCCCCCTTGGTGAT<br>GAGCTCTACCACTGTCTGGAAGGAAATCACAAGAAACAGCCTTTTGAGGAATCTACAAGAAATACTGAAG<br>ATAGTTTAAGATTTTCAGATTCTACTTCAAAGACTCCTCCTCAAGAAGAATTACCTACTCGAGTGTCATC<br>TCCTGTATTTGGAGCTACCTCTAGTATCAAAAGTGGTTTAGATTTGAATACAAGTTTGTCCCCTTCTCTT<br>TTACAGCCTGGGAAAAAAAAACATCTGAAAACACTCCCTTTTAGCAACACTTGTATATCTAGATTAGAAA<br>AAACTAGATCAAAATCTGAAGATAGTGCCCTTTTCACACATCACAGTCTTGGGTCTGAAGTGAACAAGAT<br>CATTATCCAGTCATCTAATAAACAGATACTTATAAATAAAAATATAAGTGAATCCCTAGGTGAACAGAAT<br>AGGACTGAGTACGGTAAAGATTCTAACACTGATAAACATTTGGAGCCCCTGAAATCATTGGGAGGCCGAA<br>CATCCAAAAGGAAGAAAACTGAGGAAGAAAGTGAACATGAAGTAAGCTGCCCCCAAGCTTCTTTTGATAA<br>AGAAAATGCTTTCCCTTTTCCAATGGATAATCAGTTTTCCATGAATGGAGACTGTGTGATGGATAAACCT<br>CTGGATCTGTCTGATCGATTTTCAGCTATTCAGCGTCAAGAGAAAAGCCAAGGAAGTGAGACTTCTAAAA<br>ACAAATTTAGGCAAGTGACTCTTTATGAGGCTTTGAAGACCATTCCAAAGGGCTTTTCCTCAAGCCGTAA<br>GGCCTCAGATGGCAACTGCACGTTGCCCAAAGATTCCCAGGGGAGCCCTGTTCACAGGAATGCATCATC<br>CTTCAGCCCTTGAATAAATGCTCTCCAGACAATAAACCATCATTACAAATAAAAGAAGAAAATGCTGTCT<br>TTAAAATTCCTCTACGTCCACGTGAAAGTTTGGAGACTGAGAATGTTTAGATGACATAAAGAGTGCTGG<br>TTCTCATGAGCCAATAAAAATACAAACCAGGTCAGACCATGGAGGATGTGAACTTGCATCAGTTCTTCAG<br>TTAAATCCATGTAGAACTGGTAAAATAAAGTCTCTACAAAACAACCAAGATGTATCCTTTGAAAATATCC<br>AGTGGAGTATAGATCCGGGAGCAGACCTTTCTCAGTATAAAATGGATGTTACTGTAATAGATACAAAGGA<br>TGGCAGTCAGTCAAATTAGGAGGAGAGACAGTGGACATGGACTGTACATTGGTTAGTGAAACCGTTCTC<br>TTAAAAATGAAGAAGCAAGAGCAGAAGGGAGAAAAAAGTTCAAATGAAGAAAGAAAAATGAATGATAGCT<br>TGGAAGATATGTTTGATCGGACAACACATGAAGAGTATGAATCCTGTTTTGGCAGACAGTTTCTCCCAAGC<br>AGCAGATGAAGAGGAGGAATTGTCTACTGCCACAAAGAAACTACACACTCATGGTGATAAACAAGACAAA<br>GTCAAGCAGAAAGCGTTTGTGGAGCCGTATTTTAAAGGTGATGAAAGAGAGACTAGCTTGCAAAATTTTC<br>CTCATATTGAGGTGGTTCGGAAAAAAGAGGAGAGAAGAAAACTGCTTGGGCACACGTGTAAGGAATGTGA<br>AATTTATTATGCAGATATGCCAGCAGAAGAAAGAGAAAAGAAATTGGCTTCCTGCTCAAGACACCGATTC<br>CGCTACATTCCACCCAACACACCAGAGAATTTTTGGGAAGTTGGTTTTCCTTCCACTCAGACTTGTATGG<br>AAAGAGGTTATATTAAGGAAGATCTTGATCCTTGTCCTCGTCCAAAAAGACGTCAGCCTTACAACGCAAT<br>ATTTTCTCCAAAAGGCAAGGAGCAGAAGACATAA<br>327, 847<br>MNILGSSCGSPNSADTSSDFKDLWTKLKECHDREVQGLQVKVTKLKQERILDAQRLEEFFTKNQQLREQQ<br>KVLHETIKVLEDRLRAGLCDRCAVTEEHMRKKQQEFENIRQQNLKLITELMNERNTLQEENKKLSEQLQQ<br>KIENDQQHQAAELECEEDVIPDSPITAFSFSGVNRLRRKENPHVRYIEQTHTKLEHSVCANEMRKVSKSS<br>THPQHNPNENEILVADTYDQSQSPMAKAHGTSSYTPDKSSFNLATVVAETLGLGVQEESETQGPMSPLGD<br>ELYHCLEGNHKKQPFEESTRNTEDSLRFSDSTSKTPPQEELPTRVSSPVFGATSSIKSGLDLNTSLSPSL<br>LQPGKKKHLKTLPFSNTCISRLEKTRSKSEDSALFTHHSLGSEVNKIIIQSSNKQILINKNISESLGEQN<br>RTEYGKDSNIDKHLEPLKSLGGRISKRKKTEEESEHEVSCPQASFDKENAFPFPMDNQFSMNGDCVMDKP<br>LDLSDRFSAIQRQEKSQGSETSKNKFRQVTLYEALKTIPKGFSSSRKASDGNCTLPKDSPGEPCSQECII<br>LQPLNKCSPDNKPSLQIKEENAVFKIPLRPRESLETENVLDDIKSAGSHEPIKIQTRSDHGGCELASVLQ<br>LNPCRTGKIKSLQNNQDVSFENIQWSIDPGADLSQYKMDVTVIDTKDGSQSKLGGETVDMDCTLVSETVL<br>LKMKKQEQKGEKSSNEERKMNDSLEDMFDRTTHEEYESCLADSFSQAADEEEELSTATKKLHTHGDKQDK<br>VKQKAFVEPYFKGDERETSLQNFPHIEVVRKKEERRKLLGHICKECEIYYADMPAEEREKKLASCSRHRF<br>RYIPPNTPENFWEVGFPSTQTCMERGYIKEDLDPCPRPKRRQPYNAIFSPKGKEQKTDYKDHDGDYKDHD<br>I**<br>ATGAACATCTTGGGAAGCAGCTGTGGAAGCCCTAACTCTGCAGATACATCTAGTGACTTTAAGGACCTTT<br>GGACAAAACTAAAAGAATGTCATGATAGAGAAGTACAAGGTTTACAAGTAAAAGTAACCAAGCTAAAACA<br>GGAACGAATCTTAGATGCACAAAGACTAGAAGAATTCTTCACCAAAAATCAACAGCTGAGGGAACAGCAG<br>AAAGTCCTTCATGAAACCATTAAAGTTTTAGAAGATCGGTTAAGAGCAGGCTTATGTGATCGCTGTGCAG<br>TAACTGAAGAACATATGCGGAAAAAACAGCAAGAGTTTGAAAATATCCGGCAGCAGAATCTTAAACTTAT<br>TACAGAACTTATGAATGAAAGGAATACTCTACAGGAAGAAAATAAAAAGCTTTCTGAACAACTCCAGCAG<br>AAAATTGAGAATGATCAACAGCATCAAGCAGCTGAGCTTGAGGAAGACGTTATTCCAGATTCAC<br>CGATAACAGCCTTCTCATTTTCTGGCGTTAACCGGCTACGAAGAAAGGAGAACCCCCATGTCCGATACAT<br>AGAACAAACACATACTAAATTGGAGCACTCTGTGTGTGCAAATGAAATGAGAAAAGTTTCCAAGTCTTCA<br>ACTCATCCACAACATAATCCTAATGAAAATGAAATTCTAGTAGCTGACACTTATGACCAAAGTCAATCTC<br>CAATGGCCAAAGCACATGGAACAAGCAGCTATACCCCTGATAAGTCATCTTTTAATTTAGCTACAGTTGT<br>TGCTGAAACACTTGGACTTGGTGTTCAAGAAGAATCTGAAACTCAAGGTCCCATGAGCCCCCTTGGTGAT<br>GAGCTCTACCACTGTCTGGAAGGAAATCACAAGAAACAGCCTTTTGAGGAATCTACAAGAAATACTGAAG<br>ATAGTTTAAGATTTTCAGATTCTACTTCAAAAGACTCCTCCTCAAGAAGAATTACCTACTCGAGTGTCATC<br>TCCTGTATTTGGAGCTACCTCTAGTATCAAAAGTGGTTTAGATTTGAATACAAGTTTGTCCCCTTCTCTT<br>TTACAGCCTGGGAAAAAAAAACATCTGAAAACACTCCCTTTTAGCAACACTTGTATATCTAGATTAGAAA |

TABLE VI.2-continued

Factors that promote HDR

| Factor | Sequence |
|---|---|
| | AAACTAGATCAAAATCTGAAGATAGTGCCCTTTTCACACATCACAGTCTTGGGTCTGAAGTGAACAAGAT<br>CATTATCCAGTCATCTAATAAACAGATACTTATAAATAAAAATATAAGTGAATCCCTAGGTGAACAGAAT<br>AGGACTGAGTACGGTAAAGATTCTAACACTGATAAACATTTGGAGCCCCTGAAATCATTGGGAGGCCGAA<br>CATCCAAAAGGAAGAAAACTGAGGAAGAAAGTGAACATGAAGTAAGCTGCCCCCAAGCTTCTTTTGATAA<br>AGAAAATGCTTTCCCTTTTCCAATGGATAATCAGTTTTCCATGAATGGAGACTGTGTGATGGATAAACCT<br>CTGGATCTGTCTGATCGATTTTCAGCTATTCAGCGTCAAGAGAAAAGCCAAGGAAGTGAGACTTCTAAAA<br>ACAAATTTAGGCAAGTGACTCTTTATGAGGCTTTGAAGACCATTCCAAAGGGCTTTTCCTCAAGCCGTAA<br>GGCCTCAGATGGCAACTGCACGTTGCCCAAAGATTCCCCAGGGGAGCCCTGTTCACAGGAATGCATCATC<br>CTTCAGCCCTTGAATAAATGCTCTCCAGACAATAAACCATCATTACAAATAAAAGAAGAAAATGCTGTCT<br>TTAAAATTCCTCTACGTCCACGTGAAAGTTTGGAGACTGAGAATGTTTTAGATGACATAAAGAGTGCTGG<br>TTCTCATGAGCCAATAAAAATACAAACCAGGTCAGACCATGGAGGATGTGAACTTGCATCAGTTCTTCAG<br>TTAAATCCATGTAGAACTGGTAAAATAAAGTCTCTACAAAACAACCAAGATGTATCCTTTGAAAATATCC<br>AGTGGATATAGATCCGGGAGCAGACCTTTCTCAGTATAAAATGGATGTTACTGTAATAGATACAAAGGA<br>TGGCAGTCAGTCAAAATTAGGAGGAGAGACAGTGGACATGGACTGTACATTGGTTAGTGAAACCGTTCTC<br>TTAAAAATGAAGAAGCAAGAGCAGAAGGGAGAAAAAAGTTCAAATGAAGAAAGAAAAATGAATGATAGCT<br>TGGAAGATATGTTTGATCGGACAACACATGAAGAGTATGAATCCTGTTTGGCAGACAGTTTCTCCCAAGC<br>AGCAGATGAAGAGGAGGAATTGTCTACTGCCACAAAGAAACTACACACTCATGGTGATAAACAAGACAAA<br>GTCAAGCAGAAAGCGTTTGTGGAGCCGTATTTTAAAGGTGATGAAAGAGAGACTAGCTTGCAAAATTTTC<br>CTCATATTGAGGTGGTTCGGAAAAAAGAGGAGAGAAGAAAACTGCTTGGGCACACGTGTAAGGAATGTGA<br>AATTTATTATGCAGATATGCCAGCAGAAGAAAGAGAAAAGAAATTGGCTTCCTGCTCAAGACACCGATTC<br>CGCTACATTCCACCCAACGAACCAGAGAATTTTTGGGAAGTTGGTTTTCCTTCCACTCAGACTTGTATGG<br>AAAGAGGTTATATTAAGGAAGATCTTGATCCTTGTCCTCGTCCAAAAAGACGTCAGCCTTACAACGCAAT<br>ATTTTCTCCAAAAGGCAAGGAGCAGAAGACATAA<br>MNILGSSCGSPNSADTSSDFKDLWTKLKECHDREVQGLQVKVTKLKQERILDAQRLEEFFTKNQQLREQQ<br>KVLHETIKVLEDRLRAGLCDRCAVTEEHMRKKQQEFENIRQQNLKLITELMNERNTLQEENKKLSEQLQQ<br>KIENDQQHQAAELECEEDVIPDSPITAFSFSGVNRLRRKENPHVRYIEQTHTKLEHSVCANEMRKVSKSS<br>THPQHNPNENEILVADTYDQSQSPMAKAHGTSSYTPDKSSFNLATVVAETLGLGVQEESETQGPMSPLGD<br>ELYHCLEGNHKKQPFEESTRNTEDSLRFSDSTSKTPPQEELPTRVSSPVFGATSSIKSGLDLNTSLSPSL<br>LQPGKKKHLKTLPFSNTCISRLEKTRSKSEDSALFTHHSLGSEVNKIIIQSSNKQILINKNISESLGEQN<br>RTEYGKDSNTDKHLEPLKSLGGRTSKRKKTEEESEHEVSCPQASFDKENAFPFPMDNQFSMNGDCVMDKP<br>LDLSDRFSAIQRQEKSQGSETSKNKFRQVTLYEALKTIPKGFSSSRKASDGNCTLPKDSPGEPCSQECII<br>LQPLNKCSPDNKPSLQIKEENAVFKIPLRPRESLETENVLDDIKSAGSHEPIKIQTRSDHGGCELASVLQ<br>LNPCRTGKIKSLQNNQDVSFENIQWSIDPGADLSQYKMDVTVIDTKDGSQSKLGGETVDMDCTLVSETVL<br>LKMKKQEQKGEKSSNEERKMNDSLEDMFDRTTHEEYESCLADSFSQAADEEEELSTATKKLHTHGDKQDK<br>VKQKAFVEPYFKGDERETSLQNFPHIEVVRKKEERRKLLGHTCKECEIYYADMPAEERERKKLASCSRHRF<br>RYIPPNEPENFWEVGFPSTQTCMERGYIKEDLDPCPRPKRRQPYNAIFSPKGKEQKTDYKDHDGDYKDHD<br>I* |
| EXO1 | MGIQGLLQFIKEASEPIHVRKYKGQVVAVDTYCWLHKGAIACAEKLAKGEPTDRYVGFCM<br>KFVNMLLSHGIKPILVFDGCTLPSKKEVERSRRERRQANLLKGKQLLREGKVSEARECFT<br>RSINITHAMAHKVIKAARSQGVDCLVAPYEADAQLAYLNKAGIVQATITEDSDLLAFGCK<br>KVILKMDQFGNGLEIDQARLGMCRQLGDVFTEEKFRYMCILSGCDYLSSLRGIGLAKACK<br>VLRLANNPDIVKVIKKIGHYLKMNITVPEDYINGFIRANNTFLYQLVFDPIKRKLIPLNA<br>YEDDVDPETLSYAGQYVDDSIALQIALGNKDINTFEQIDDYNPDTAMPAHSRSHSWDDKT<br>CQKSANVSSIWHRNYSPRPESGTVSDAPQLKENPSTVGVERVISTKGLNLPRKSSIVKRP<br>RSAELSEDDLLSQYSLSFTKKTKKNSSEGNKSLSFSEVFVPDLVNGPTNKKSVSTPPRTR<br>NKFATFLQRKNEESGAVVVPGTRSRFFCSSDSTDCVSNKVSIQPLDETAVTDKENNLHES<br>EYGDQEGKRLVDTDVARNSSDDIPNNHIPGDHIPDKATVFTDEEESYSFESSKFTRTISPP<br>TLGTLRSCFSWSGGLGDFSRTPSPSPSTALQQFRRKSDSPTSLPENNMSDVSQLKSEESS<br>DDESHPLREEACSSQSQESGEFSLQSSNASKLSQCSSKDSDSEESDCNIKLLDSQSDQTS<br>KLRLSHFSKKDTPLRNKVPGLYKSSSADSLSTTKIKPLGPARASGLSKKPASIQKRKHHN<br>AENKPGLQIKLNELWKNFGFKKF (Exo1 Isoform 1 CCDS 44336.1)<br>MGIQGLLQFIKEASEPIHVRKYKGQVVAVDTYCWLHKGAIACAEKLAKGEPTDRYVGFCM<br>KFVNMLLSHGIKPILVFDGCTLPSKKEVERSRRERRQANLLKGKQLLREGKVSEARECFT<br>RSINITHAMAHKVIKAARSQGVDCLVAPYEADAQLAYLNKAGIVQATITEDSDLLAFGCK<br>KVILKMDQFGNGLEIDQARLGMCRQLGDVFTEEKFRYMCILSGCDYLSSLRGIGLAKACK<br>VLRLANNPDIVKVIKKIGHYLKMNITVPEDYINGFIRANNTFLYQLVFDPIKRKLIPLNA<br>YEDDVDPETLSYAGQYVDDSIALQIALGNKDINTFEQIDDYNPDTAMPAHSRSHSWDDKT<br>CQKSANVSSIWHRNYSPRPESGTVSDAPQLKENPSTVGVERVISTKGLNLPRKSSIVKRP<br>RSAELSEDDLLSQYSLSFTKKTKKNSSEGNKSLSFSEVFVPDLVNGPTNKKSVSTPPRTR<br>NKFATFLQRKNEESGAVVVPGTRSRFFCSSDSTDCVSNKVSIQPLDETAVTDKENNLHES<br>EYGDQEGKRLVDTDVARNSSDDIPNNHIPGDHIPDKATVFTDEEESYSFESSKFTRTISPP<br>TLGTLRSCFSWSGGLGDFSRTPSPSPSTALQQFRRKSDSPTSLPENNMSDVSQLKSEESS<br>DDESHPLREEACSSQSQESGEFSLQSSNASKLSQCSSKDSDSEESDCNIKLLDSQSDQTS<br>KLRLSHFSKKDTPLRNKVPGLYKSSSADSLSTTKIKPLGPARASGLSKKPASIQKRKHHN<br>AENKPGLQIKLNELWKNFGFKKDSEKLPPCKKPLSPVRDNIQLTPEAEEDIFNKPECGRV<br>QRAIFQ (Exo1 Isoform 2 CCDS 1620.1) |
| BLM | MAAVPQNNLQEQLERHSARTLNNKLSLSKPKFSGFIFKKKISSDNNVSVINVSVAKTPVL<br>RNKDVNVIEDFSFSEPLPNTINQQRVKDFFKNAPAGQETQRGGSKSLLPDFLQTPKEVVC<br>TTQNTPTVKKSRDTALKKLEFSSSPDSLSTINDWDDMDDFDTSETSKSFVTPPQSHFVRV<br>STAQKSKKGKRNFFKAQLYTTNTVKTDLPPPSSESEQIDLTEEQKDDSEWLSSDVICIDD<br>GPIAEVHINEDAQESDSLKTHLEDERDNSEKKKNLEEAELHSTEKVPCIEFDDDDYDTDF<br>VPPSPEEIISASSSSSKCLSTLKDLDTSDRKEDVLSTSKDLLSKPEKMSMQELNPETSTD<br>CDARQISLQQQLIHVMEHICKLIDTIPDDKLKLLDCGNELLQQRNIRRKLLTEVDFNKSD<br>ASLLGSLWRYRPDSLDGPMEGDSCPTGNSMKELNFSHLPSNSVSPGDCLLTTTLGKTGFS |

TABLE VI.2-continued

Factors that promote HDR

| Factor | Sequence |
|---|---|
| | ATRKNLFERPLFNTHLQKSFVSSNWAETPRLGKKNESSYFPGNVLTSTAVKDQNKHTASI<br>NDLERETQPSYDIDNFDIDDFDDDDDWEDIMHNLAASKSSTAAYQPIKEGRPIKSVSERL<br>SSAKTDCLPVSSTAQNINFSESIQNYTDKSAQNLASRNLKHERFQSLSFPHTKEMMKIFH<br>KKFGLHNFRTNQLEAINAALLGEDCFILMPTGGGKSLCYQLPACVSPGVTVVISPLRSLI<br>VDQVQKLTSLDIPATYLTGDKTDSEATNIYLQLSKKDPIIKLLYVTPEKICASNRLISTL<br>ENLYERKLLARFVIDEAHCVSQWGHDFRQDYKRMNMLRQKFPSVPVMALTATANPRVQKD<br>ILTQLKILRPQVFSMSFNRHNLKYYVLPKKPKKVAFDCLEWIRKHHPYDSGITYCLSRRE<br>CDTMADTLQRDGLAALAYHAGLSDSARDEVQQKWINQDGCQVICATIAFGMGIDKPDVRF<br>VIHASLPKSVEGYYQESGRAGRDGEISHCLLFYTYHDVTRLKRLIMMEKDGNHHTRETHF<br>NNLYSMVHYCENITECRRIQLLAYFGENGFNPDFCKKHPDVSCDNCCKTKDYKTRDVTDD<br>VKSIVRFVQEHSSSQGMRNIKHVGPSGRFTMNMLVDIFLGSKSAKIQSGIFGKGSAYSRH<br>NAERLFKKLILDKILDEDLYINANDQATAYVMLGNKAQTVLNGNLKVDFMETENSSSVKK<br>QKALVAKVSQREEMVKKCLGELTEVCKSLGKVFGVHYFNIFNTVTLKKLAESLSSDPEVL<br>LQIDGVTEDKLEKYGAEVISVLQKYSEWTSPAEDSSPGISLSSSRGPGRSAAEELDEEIP<br>VSSHYFASKTRNERKRKKMPASQRSKRRKTASSGSKAKGGSATCRKISSKTKSSSIIGSS<br>SASHTSQATSGANSKLGIMAPPKPINRPFLKPSYAFS (BLM Isoform 1 CCDS 10363.1)<br>MAAVPQNNLQEQLERHSARTLNNKLSLSKPKFSGFIFKKKISSDNNVSVINVSVAKTPVL<br>RNKDVNVIEDFSFSEPLPNTINQQRVKDFFKNAPAGQETQRGGSKSLLPDFLQTPKEVVC<br>TTQNPTPVKKSRDTALKKLEFSSSPDSLSTINDWDDMDDFDTSETSKSFVTPPQSHFVRV<br>STAQKSKKGKRNFFKAQLYTTNTVKTDLPPPSSESEQIDLTEEQKDDSEWLSSDVICIDD<br>GPIAEVHINEDAQESDSLKTHLEDERDNSEKKKNLEEAELHSTEKVPCIEFDDDDYDTDF<br>VPPSPEEIISASSSSSKCLSTLKDLDTSDRKEDVLSTSKDLLSKPEKMSMQELNPETSTD<br>CDARQISLQQQLIHVMEHICKLIDTIPDDKLKLLDCGNELLQQRNIRRKLLTEVDFNKSD<br>ASLLGSLWRYRPDSLDGPMEGDSCPTGNSMKELNFSHLPSNSVSPGDCLLTTTLGKTGFS<br>ATRKNLFERPLFNTHLQKSFVSSNWAETPRLGKKNESSYFPGNVLTSTAVKDQNKHTASI<br>NDLERETQPSYDIDNFDIDDFDDDDDWEDIMHNLAASKSSTAAYQPIKEGRPIKSVSERL<br>SSAKTDCLPVSSTAQNINFSESIQNYTDKSAQNLASRNLKHERFQSLSFPHTKEMMKIFH<br>KKFGLHNFRTNQLEAINAALLGEDCFILMPTGGGKSLCYQLPACVSPGVTVVISPLRSLI<br>VDQVQKLTSLDIPATYLTGDKTDSEATNIYLQLSKKDPIIKLLYVTPEKICASNRLISTL<br>ENLYERKLLARFVIDEAHCVSQWGHDFRQDYKRMNMLRQKFPSVPVMALTATANPRVQKD<br>ILTQLKILRPQVFSMSFNRHNLKYYVLPKKPKKVAFDCLEWIRKHHPYDSGITYCLSRRE<br>CDTMADTLQRDGLAALAYHAGLSDSARDEVQQKWINQDGCQVICATIAFGMGIDKPDVRF<br>VIHASLPKSVEGYYQESGRAGRDGEISHCLLFYTYHDVTRLKRLIMMEKDGNHHTRETHF<br>NNLYSMVHYCENITECRRIQLLAYFGENGFNPDFCKKHPDVSCDNCCKTKDYKTRDVTDD<br>VKSIVRFVQEHSSSQGMRNIKHVGPSGRFTMNMLVDIFLESLSSDPEVLLQIDGVTEDKL<br>EKYGAEVISVLQKYSEWTSPAEDSSPGISLSSSRGPGRSAAEELDEEIPVSSHYFASKTR<br>NERKRKKMPASQRSKRRKTASSGSKAKGGSATCRKISSKTKSSSIIGSSSASHTSQATSG<br>ANSKLGIMAPPKPINRPFLKPSYAFS (BLM Isoform 2 CCDS 73782.1) |
| RECQ1 (also called RECQL1) | MASVSALTEELDSITSELHAVEIQIQELTERQQELIQKKKVLTKKIKQCLEDSDAGASNE<br>YDSSPAAWNKEDFPWSGKVKDILQNVFKLEKFRPLQLETINVTMAGKEVFLVMPTGGGKS<br>LCYQLPALCSDGFTLVICPLISLMEDQLMVLKQLGISATMLNASSSKEHVKWVHAEMVNK<br>NSELKLIYVTPEKIAKSKMFMSRLEKAYEARRFTRIAVDEVHCCSQWGHDFRPDYKALGI<br>LKRQFPNASLIGLTATATNHVLTDAQKILCIEKCFTFTASFNRPNLYYEVRQKPSNTEDF<br>IEDIVKLINGRYKGQSGITYCFSQKDSEQVTVSLQNLGIHAGAYHANLEPEDKTTVHRKW<br>SANEIQVVVATVAFGMGIDKPDVRFVIHHSMSKSMENYYQESGRAGRDDMKADCILYYGF<br>GDIFRISSMVVMENVGQQKLYEMVSYCQNISKCRRVLMAQHFDEVWNSEACNKMCDNCCK<br>DSAFERKNITEYCRDLIKILKQAEELNEKLTPLKLIDSWMGKGAAKLRVAGVVAPTLPRE<br>DLEKIIAHFLIQQYLKEDYSFTAYATISYLKIGPKANLLNNEAHAITMQVTKSTQNSFRA<br>ESSQTCHSEQGDKKMEEKNSGNFQKKAANMLQQSGSKNTGAKKRKIDDA (RECQL1 CCDS 31756.1) |
| WRN | MSEKKLETTAQQRKCPEWMNVQNKRCAVEERKACVRKSVFEDDLPFLEFTGSIVYSYDAS<br>DCSFLSEDISMSLSDGDVVGFDMEWPPLYNRGKLGKVALIQLCVSESKCYLFHVSSMSVF<br>PQGLKMLLENKAVKKAGVGIEGDQWKLLRDFDIKLKNFVELTDVANKKLKCTETWSLNSL<br>VKHLLGKQLLKDKSIRCSNWSKFPLTEDQKLYAATDAYAGFITYRNLEILDDTVQRFAIN<br>KEEEILLSDMNKQLTSISEEVMDLAKHLPHAFSKLENPRRVSILLKKDISENLYSLRRMI<br>GSTNIETELRPSNNLNLLSFEDSTTGGVQQKQIREHEVLIHVEDETWDPTLDHLAKHDGE<br>DVLGNKVERKEDGFEDGVEDNKLKENMERACLMSLDITEHELQILEQQSQEEYLSDIAYK<br>STEHLSPNDNENDTSYVIESDEDLEMEMLKHLSPNDNENDTSYVIESDEDLEMEMLKSLE<br>NLNSGTVEPTHSKCLKMERNLGLPTKEEEEDDENEANEGEEDDDKDFLWPAPNEEQVTCL<br>KMYFGHSSFKPVQWKVIHSVLEERRDNVAVMATGYGKSLCFQYPPVYVGKIGLVISPLIS<br>LMEDQVLQLKMSNIPACFLGSAQSENVLTDIKLGKYRIVYVTPEYCSGNMGLLQQLEADI<br>GITLIAVDEAHCISEWGHDFRDSFRKLGSLKTALPMVPIVALTATASSSIREDIVRCLNL<br>RNPQITCTGFDRPNLYLEVRRKTGNILQDLQPFLVKTSSHWEFEGPTIIYCPSRKMTQQV<br>TGELRKLNLSCGTYHAGMSFSTRKDIHHRFVRDEIQCVIATIAFGMGINKADIRQVIHYG<br>APKDMESYYQEIGRAGRDGLQSSCHVLWAPADINLNRHLLTEIRNEKFRLYKLKMMAKME<br>KYLHSSRCRRQIILSHFEDKQVQKASLGIMGTEKCCDNCRSRLDHCYSMDDSEDTSWDFG<br>PQAFKLLSAVDILGEKFGIGLPILFLRGSNSQRLADQYRRHSLFGTGKDQTESWWKAFSR<br>QLITEGFLVEVSRYNKFMKICALTKKGRNWLHKANTESQSLILQANEELCPKKLLLPSSK<br>TVSSGTKEHCYNQVPVELSTEKKSNLEKLYSYKPCDKISSGSNISKKSIMVQSPEKAYSS<br>SQPVISAQEQETQIVLYGKLVEARQKHANKMDVPPAILATNKILVDMAKMRPTTVENVKR<br>IDGVSEGKAAMLAPLLEVIKHFCQTNSVQTDLFSSTKPQEEQKTSLVAKNKICTLSQSMA<br>ITYSLFQEKKMPLKSIAESRILPLMTIGMHLSQAVKAGCPLDLERAGLTPEVQKIIADVI |

TABLE VI.2-continued

Factors that promote HDR

| Factor | Sequence |
|---|---|
| | RNPPVNSDMSKISLIRMLVPENIDTYLIHMAIEILKHGPDSGLQPSCDVNKRRCFPGSEE<br>ICSSSKRSKEEVGINTETSSAERKRRLPVWFAKGSDTSKKLMDKTKRGGLFS (WRN<br>CCDS 6082.1) |
| RTS (also called RECQ4) | MERLRDVRERLQAWERAFRRQRGRRPSQDDVEAAPEETRALYREYRTLKRTTGQAGGGLRSSESLPAAAE<br>EAPEPRCWGPHLNRAATKSPQSTPGRSRQGSVPDYGQRLKANLKGTLQAGPALGRRPWPLGRASSKASTP<br>KPPGTGPVPSFAEKVSDEPPQLPEPQPRPGRLQHLQASLSQRLGSLDPGWLQRCHSEVPDFLGAPKACRP<br>DLGSEESQLLIPGESAVLGPGAGSQGPEASAFQEVSIRVGSPQPSSSGGEKRRWNEEPWESPAQVQQESS<br>QAGPPSEGAGAVAVEEDPPGEPVQAQPPQPCSSPSNPRYHGLSPSSQARAGKAEGTAPLHIFPPRLARHDR<br>GNYVRLNMKQKHYVRGRALRSRLLRKQAWKQKWRKKGECFGGGGATVTTKESCFLNEQFDHWAAQCPRPA<br>SEEDTDAVGPEPLVPSPQPVPEVPSLDPTVLPLYSLGPSGQLAETPAEVFQALEQLGHQAFRPGQERAVM<br>RILSGISTLLVLPTGAGKSLCYQLPALLYSRRSPCLTLVVSPLLSLMDDQVSGLPPCLKAACIHSGMTRK<br>QRESVLQKIRAAQVHVLMLTPEALVGAGGLPPAAQLPPVAFACIDEAHCLSQWSHNFRPCYLRVCKVLRE<br>RMGVHCFLGLTATATRRTASDVAQHLAVAEEPDLHGPAPVPTNLHLSVSMDRDTDQALLTLLQGKRFQNL<br>DSIIIYCNRREDTERIAALLRTCLHAAWVPGSGGRAPKTTAEAYHAGMCSRERRRVQRAFMQGQLRVVVA<br>TVAFGMGLDRPDVRAVLHLGLPPSFESYVQAVGRAGRDGQPAHCHLFLQPQGEDLRELRRHVHADSTDFL<br>AVKRLVQRVFPACTCTCTRPPSEQEGAVGGERPVPKYPPQEAEQLSHQAAPGPRRVCMGHERALPIQLTV<br>QALDMPEEAIETLLCYLELHPHHWLELLATTYTHCRLNCPGGPAQLQALAHRCPPLAVCLAQQLPEDPGQ<br>GSSSVEFDMVKLVDSMGWELASVRRALCQLQWDHEPRTGVRRGTGVLVEFSELAFHLRSPGDLTAEEKDQ<br>ICDFLYGRVQARERQALARLRRTFQAFHSVAFPSCGPCLEQQDEERSTRLKDLLGRYFEEEEGQEPGGME<br>DAQGPEPGQARLQDWEDQVRCDIRQFLSLRPEEKFSSRAVARIFHGIGSPCYPAQVYGQDRRFWRKYLHL<br>SFHALVGLATEELLQVAR (RECQ4, CCDS 75804.1) |
| RECQ5 | MSSHHTTFPFDPERRVRSTLKKVFGFDSFKTPLQESATMAVVKGNKDVFVCMPTGAGKSLCYQLPALLAK<br>GITIVVSPLIALIQDQVDHLLTLKVRVSSLNSKLSAQERKELLADLEREKPQTKILYITPEMAASSSFQP<br>TLNSLVSRHLLSYLVVDEAHCVSQWGHDFRPDYLRLGALRSRLGHAPCVALTATATPQVQEDVFAALHLK<br>KPVAIFKTPCFRANLFYDVQFKELISDPYGNLKDFCLKALGQEADKGLSGCGIVYCRTREACEQLAIELS<br>CRGVNAKAYHAGLKASERTLVQNDWMEEKVPVIVATISFGMGVDKANVRFVAHWNIAKSMAGYYQESGRA<br>GRDGKPSWCRLYYSRNDRDQVSFLIRKEVAKLQEKRGNKASDKATIMAFDALVTFCEELGCRHAAIAKYF<br>GDALPACAKGCDHCQNPTAVRRRLEALERSSSWSKTCIGPSQGNGFDPELYEGGRKGYGDFSRYDEGSGG<br>SGDEGRDEAHKREWNLFYQKMQLRKGKDPKIEEFVPPDENCPLKEASSRRIPRLTVKAREHCLRLLEEA<br>LSSNRQSTRTADEADLRAKAVELEHETFRNAKVANLYKASVLKKVADIHRASKDGQPYDMGGSAKSCSAQ<br>AEPPEPNEYDIPPASHVYSLKPKRVGAGFPKGSCPFQTATELMETTRIREQAPQPERGGEHEPPSRPCGL<br>LDEDGSEPLPGPRGEVPGGSAHYGGPSPEKKAKSSSGGSSLAKGRASKKQQLLATAAHKDSQSIARFFCR<br>RVESPALLASAPEAEGACPSCEGVQGPPMAPEKYTGEEDGAGGHSPAPPQTEECLRERPSTCPPRDQGTP<br>EVQPTPAKDTWKGKRPRSQQENPESQPQKRPRPSAKPSVVAEVKGSVSASEQGTLNPTAQDPFQLSAPGV<br>SLKEAANVVVKCLTPFYKEGKFASKELFKGFARHLSHLLTQKTSPGRSVKEEAQNLIRHFFHGRARCESE<br>ADWHGLCGPQR (ATP-dependent DNA helicase Q5 isoform 1 [Homo sapiens],<br>CCDS 42380.1)<br>MSSHHTTFPFDPERRVRSTLKKVFGFDSFKTPLQESATMAVVKGNKDVFVCMPTGAGKSLCYQLPALLAK<br>GITIVVSPLIALIQDQVDHLLTLKVRVSSLNSKLSAQERKELLADLEREKPQTKILYITPEMAASSSFQP<br>TLNSLVSRHLLSYLVVDEAHCVSQWGHDFRPDYLRLGALRSRLGHAPCVALTATATPQVQEDVFAALHLK<br>KPVAIFKTPCFRANLFYDVQFKELISDPYGNLKDFCLKALGQEADKGLSGCGIVYCRTREACEQLAIELS<br>CRGVNAKAYHAGLKASERTLVQNDWMEEKVPVIVATISFGMGVDKANVRFVAHWNIAKSMAGYYQESGRA<br>GRDGKPSWCRLYYSRNDRDQVSFLIRKEVAKLQEKRGNKASDKATIMAFDALVTFCEELGRWGRGHGKSL<br>RAAWCSQVVSRHAEL (ATP-dependent DNA helicase Q5 isoform 2 [Homo<br>sapiens], CCDS 32735.1)<br>MSSHHTTFPFDPERRVRSTLKKVFGFDSFKTPLQESATMAVVKGNKDVFVCMPTGAGKSLCYQLPALLAK<br>GITIVVSPLIALIQDQVDHLLTLKVRVSSLNSKLSAQERKELLADLEREKPQTKILYITPEMAASSSFQP<br>TLNSLVSRHLLSYLVVDEAHCVSQWGHDFRPDYLRLGALRSRLGHAPCVALTATATPQVQEDVFAALHLK<br>KPVAIFKTPCFRANLFYDVQFKELISDPYGNLKDFCLKALGQEADKGLSGCGIVYCRTREACEQLAIELS<br>CRGVNAKAYHAGLKASERTLVQNDWMEEKVPVIVATISFGMGVDKANVRFVAHWNIAKSMAGYYQESGRA<br>GRDGKPSWCRLYYSRNDRDQVSFLIRKEVAKLQEKRGNKASDKATIMAFDALVTFCEELG (CCDS<br>45777.1) |
| RPA3 | MVDMMDLPRSRINAGMLAQFIDKPVCFVGRLEKIHPTGKMFILSDGEGKNGTIELMEPLDEEISGIVEVV<br>GRVTAKATILCTSYVQFKEDSHPFDLGLYNEAVKIIHDFPQFYPLGIVQHD (replication<br>protein A3, 14 kDa, isoform CRA_a [Homo sapiens], CCDS 5356.1) |
| PP4 | MAEISDLDRQIEQLRRCELIKESEVKALCAKAREILVEESNVQRVDSPVTVCGDIHGQFYDLKELFRVGG<br>DVPETNYLFMGDFVDRGFYSVETFLLLLALKVRYPDRITLIRGNHESRQITQVYGFYDECLRKYGSVTVW<br>RYCTEIFDYLSLSAIIDGKIFCVHGGLSPSIQTLDQIRTIDRKQEVPHDGPMCDLLWSDPEDTTGWGVSP<br>RGAGYLFGSDVVAQFNAANDIDMICRAHQLVMEGYKWHFNETVLTVWSAPNYCYRCGNVAAILELDEHLQ<br>KDFIIFEAAPQETRGIPSKKPVADYFL (PPP4C protein phosphatase 4, catalytic<br>subunit, CCDS 10669.1) |
| RAD51 | MAMQMQLEANADTSVEEESFGPQPISRLEQCGINANDVKKLEEAGFHTVEAVAYAPKKELINIKGISEAK<br>ADKILAEAAKLVPMGFTTATEFHQRRSEIIQITTGSKELDKLLQGGIETGSITEMFGEFRTGKTQICHTL<br>AVTCQLPIDRGGGEGKAMYIDTEGTFRPERLLAVAERYGLSGSDVLDNVAYARAFNTDHQTQLLYQASAM<br>MVESRYALLIVDSATALYRTDYSGRGELSARQMHLARFLRMLLRLADEFGVAVVITNQVVAQVDGAAMFA<br>ADPKKPIGGNITAHASTTRLYLRKGRGETRICKIYDSPCLPEAEAMFAINADGVGDAKD (RAD51<br>[Homo sapiens], CCDS 10062.1)<br>MAMQMQLEANADTSVEEESFGPQPISRLEQCGINANDVKKLEEAGFHTVEAVAYAPKKELINIKGISEAK<br>ADKILTESRSVARLECNSVILVYCTLRLSGSSDSPASASRVVGTTGGIETGSITEMFGEFRTGKTQICHT<br>LAVTCQLPIDRGGGEGKAMYIDTEGTFRPERLLAVAERYGLSGSDVLDNVAYARAFNTDHQTQLLYQASA<br>MMVESRYALLIVDSATALYRTDYSGRGELSARQMHLARFLRMLLRLADEFGVAVVITNQVVAQVDGAAMF |

TABLE VI.2-continued

Factors that promote HDR

| Factor | Sequence |
|---|---|
| | AADPKKPIGGNITAHASTTRLYLRKGRGETRICKIYDSPCLPEAEAMFAINADGVGDAKD (RAD51 [Homo sapiens], CCDS 53931.1)<br>MAMQMQLEANADTSVEEESFGPQPISRLEQCGINANDVKKLEEAGFHTVEAVAYAPKKELINIKGISEAK<br>ADKILAEAAKLVPMGFTTATEFHQRRSEIIQITTGSKELDKLLQGGIETGSITEMFGEFRTGKTQICHTL<br>AVTCQLPIDRGGGEGKAMYIDTEGTFRPERLLAVAERYGLSGSDVLDNVAYARAFNTDHQTQLLYQASAM<br>MVESRYALLIVDSATALYRTDYSGRGELSARQMHLARFLRMLLRLADEIVSEERKRGNQNLQNLRLSLSS<br>(CCDS 53932.1) |
| BACH1 | MSLSENSVFAYESSVHSTNVLLSLNDQRKKDVLCDVTIFVEGQRFRAHRSVLAACCSSYFHSRIVGQADGE<br>LNITLPEEVTVKGFEPLIQFAYTAKLILSKENVDEVCKCVEFLSVHNIEESCFQFLKFKFLDSTADQQEC<br>PRKKCFSSHCQKTDLKLSLLDQRDLETDEVEEFLENKNVQTPQCKLRRYQGNAKASPPLQDSASQTYESM<br>CLEKDAALALPSLCPKYRKFQKAFGTDRVRTGESSVKDIHASVQPNERSENECLGGVPECRDLQVMLKCD<br>ESKLAMEPEETKKDPASQCPTEKSEVTPFPHNSSIDPHGLYSLSLLHTYDQYGDLNFAGMQNTTVLTEKP<br>LSGTDVQEKTFGESQDLPLKSDLGTREDSSVASSDRSSVEREVAEHLAKGFWSDICSTDTPCQMQLSPAV<br>AKDGSEQISQKRSECPWLGIRISESPEPGQRTFTTLSSVNCPFISTLSTEGCSSNLEIGNDDYVSEPQQE<br>PCPYACVISLGDDSETDTEGDSESCSAREQECEVKLPFNAQRIISLSRNDFQSLLKMHKLTPEQLDCIHD<br>IRRRSKNRIAAQRCRKRKLDCIQNLESEIEKLQSEKESLLKERDHILSTLGETKQNLTGLCQKVCKEAAL<br>SQEQIQILAKYSAADCPLSFLISEKDKSTPDGELALPSIFSLSDRPPAVLPPCARGNSEPGYARGQESQQ<br>MSTATSEQAGPAEQCRQSGGISDFCQQMTDKCTTDE (transcription regulator protein BACH1 [Homo sapiens] CCDS 13585.1) |
| FANCJ | MSSMWSEYTIGGVKIYFPYKAYPSQLAMMNSILRGLNSKQHCLLESPTGSGKSLALLCSA<br>LAWQQSLSGKPADEGVSEKAEVQLSCCCACHSKDFTNNDMNQGTSRHFNYPSTPPSERNG<br>TSSTCQDSPEKTTLAAKLSAKKQASIYRDENDDFQVEKKRIRPLETTQQIRKRHCFGTEV<br>HNLDAKVDSGKTVKLNSPLEKINSFSPQKPPGHCSRCCCSTKQGNSQESSNTIKKDHTGK<br>SKIPKIYFGTRTHKQIAQITRELRRTAYSGVPMTILSSRDHTCVHPEVVGNFNRNEKCME<br>LLDGKNGKSCYFYHGVHKISDQHTLQTFQGMCKAWDIEELVSLGKKLKACPYYTARELIQ<br>DADIIFCPYNYLLDAQIRESMDLNLKEQVVILDEAHNIEDCARESASYSVTEVQLRFARD<br>ELDSMVNNIRKKDHEPLRAVCCSLINWLEANAEYLVERDYESACKIWSGNEMLLTLHKM<br>GITTATFPILQGHFSAVLQKEEKISPIYGKEEAREVPVISASTQIMLKGLFMVLDYLFRQ<br>NSRFADDYKIAIQQTYSWTNQIDISDKNGLLVLPKNKKRSRQKTAVHVLNFWCLNPAVAF<br>SDINGKVQTIVLTSGTLSPMKSFSSELGVTFTIQLEANHIIKNSQVWVGTIGSGPKGRNL<br>CATFQNTETFEFQDEVGALLLSVCQTVSQGILCFLPSYKLLEKLKERWLSTGLWHNLELV<br>KTVIVEPQGGEKTNFDELLQVYYDAIKYKGEKDGALLVAVCRGKVSEGLDFSDDNARAVI<br>TIGIPFPNVKDLQVELKRQYNDHHSKLRGLLPGRQWYEIQAYRALNQALGRCIRHRNDWG<br>ALILVDDRFRNNPSRYISGLSKWVRQQIQHHSTFESALESLAEFSKKHQKVLNVSIKDRT<br>NIQDNESTLEVTSLKYSTSPYLLEAASHLSPENFVEDEAKICVQELQCPKIITKNSPLPS<br>SIISRKEKNDPVFLEEAGKAEKIVISRSTSPTFNKQTKRVSWSSFNSLGQYFTGKIPKAT<br>PELGSSENSASSPPRFKTEKMESKTVLPFTDKCESSNLTVNTSFGSCPQSETIISSLKID<br>ATLTRKNHSEHPLCSEEALDPDIELSLVSEEDKQSTSNRDFETEAEDESIYFTPELYDPE<br>DTDEEKNDLAETDRGNRLANNSDCILAKDLFEIRTIKEVDSAREVKAEDCIDTKLNGILH<br>IEESKIDDIDGNVKTTWINELELGKTHEIEIKNFKPSPSKNKGMFPGFK (FancJ CCDS 11631.1) |
| Topbp1 | MSRNDKEPFFVKFLKSSDNSKCFFKALESIKEFQSEEYLQIITEEEALKIKENDRSLYICDPFSGVVFDH<br>LKKLGCRIVGPQVVIFCMHHQRCVPRAEHPVYNMVMSDVTISCTSLEKEKREEVHKYVQMMGGRVYRDLN<br>VSVTHLIAGEVGSKKYLVAANLKKPILLPSWIKTLWEKSQEKKITRYTDINMEDFKCPIFLGCTICVTGL<br>CGLDRKEVQQLTVKHGGQYMGQLKMNECTHLIVQEPKGQKYECAKRWNVHCVTTQWFFDSIEKGFCQDES<br>IYKTEPRPEAKTMPNSSTPTSQINTIDSRTLSDVSNISNINASCVSESICNSLNSKLEPTLENLENLDVS<br>AFQAPEDLLDGCRIYLCGFSGRKLDKLRRLINSGGGVRFNQLNEDVTHVIVGDYDDELKQFWNKSAHRPH<br>VVGAKWLLECFSKGYMLSEEPYIHANYQPVEIPVSHKPESKAALLKKKNSSFSKKDFAPSEKHEQADEDL<br>LSQYENGSSTVVEAKTSEARPFNDSTHAEPLNDSTHISLQEENQSSVSHCVPDVSTITEEGLFSQKSFLV<br>LGFSNENESNIANIIKENAGKIMSLLSRTVADYAVVPLLGCEVEATVGEVVTNTWLVTCIDYQTLFDPKS<br>NPLFTPVPVMTGMTPLEDCVISFSQCAGABEKESLTFLANLLGASVQEYFVRKSNAKKGMFASTHLILKER<br>GGSKYEAAKKWNLPAVTIAWLLETARTGKRADESHFLIENSTKEERSLETEITNGINLNSDTAEHPGTRL<br>QTHRKTVVTPLDMNRFQSKAFRAVVSQHARQVAASPAVGQPLQKEPSLHLDTPSKFLSKDKLFKPSFDVK<br>DALAALETPGRPSQQKRKPSTPLSEVIVKNLQLALANSSRNAVALSASPQLKEAQSEKEEAPKPLHKVVV<br>CVSSKKLSKKQSELNGIAASLGADYRWSFDETVTHFIYQGRPNDTNREYKSVKERGVHIVSEHWLLDCAQE<br>CKHLPESLYPHTYNPKMSLDISAVQDGRLCNSRLLSAVSSTKDDEPPDPLILEENDVDNMATNNKESAPSN<br>GSGKNDSKGVLTQTLEMRENFQKQLQEIMSATSIVKPQGQRTSLSRSGCNSASSTPDSTRSARSGRSRVL<br>EALRQSRQTVPDVNTEPSQNEQIIWDDPTAREERARLASNLQWPSCPTQYSELQVDIQNLEDSPFQKPLH<br>DSEIAKQAVCDPGNIRVTEAPKHPISEELETETPIKDSHLIPTPQAPSIAFPLANPPVAPHPREKIITIEET<br>HEELKKQYIFQLSSLNPQERIDYCHLIEKLGGLVIEKQCFDPTCTHIVVGHPLRNEKYLASVAAGKWVLH<br>RSYLEACRTAGHFVQEEDYEWGSSSILDVLTGINVQQRRLALAAMRWRKKIQQRQESGIVEGAFSGWKVI<br>LHVDQSREAGFKRLLQSGGAKVLPGHSVPLFKEATHLFSDLNKLKPDDSGVNIAEAAAQNVYCLRTEYIA<br>DYLMQESPPHVENYCLPEAISFIQNNKELGTGLSQKRKAPTEKNKIKRPRVH (Topbp1, CCDS 46919.1) |
| TOPO III | MIFPVARYALRWLRRPEDRAFSRAAMEMALRGVRKVLCVAEKNDAAKGIADLLSNGRMRRREGLSKFNKI<br>YEFDYHLYGQNVTMVMTSVSGHLLAHDFQMQFRKWQSCNPLVLFEAEIEKYCPENFVDIKKTLERETRQC<br>QALVIWTDCDREGENIGFEIIHVCKAVKPNLQVLRARFSEITPHAVRTACENLTEPDQRVSDAVDVRQEL<br>DLRIGAAFTRFQTLRLQRIFPEVLAEQLISYGSCQFPTLGFVVERFKAIQAFVPEIFHRIKVTHDHKDGI<br>VEFNWKRHRLFNHTACLVLYQLCVEDPMATVVEVRSKPKSKWRPQALDTVELEKLASRKLRINAKETMRI<br>AEKLYTQGYISYPRTETNIFPRDLNLTVLVEQQTPDPRWGAFAQSILERGGPTPRNGNKSDQAHPPIHPT<br>KYTNNLQGDEQRLYEFIVRHFLACCSQDAQGQETTVEIDIAQERFVAHGLMILARNYLDVPYDHWSDKI<br>LPVYEQGSHFQPSTVEMVDGETSPPKLLTEADLIALMEKHGIGTDATHAEHIETIKARMYVGLTPDKRFL |

TABLE VI.2-continued

Factors that promote HDR

| Factor | Sequence |
|---|---|
|  | PGHLGMGLVEGYDSMGYEMSKPDLRAELEADLKLICDGKKDKFVVLRQQVQKYKQVFIEAVAKAKKLDEA<br>LAQYFGNGTELAQQEDIYPAMPEPIRKCPQCNKDMVLKTKKNGGFYLSCMGFPECRSAVWLPDSVLEASR<br>DSSVCPVCQPHPVYRLKLKFKRGSLPPTMPLEFVCCIGGCDDTLREILDLRFSGGPPRASQPSGRLQANQ<br>SLNRMDNSQHPQPADSRQTGSSKALAQTLPPPTAAGESNSVTCNCGQEAVLLTVRKEGPNRGRQFFKCNG<br>GSCNFFLWADSPNPGAGGPPALAYRPLGASLGCPPGPGIHLGGFGNPGDGSGSGTSCLCSQPSVTRTVQK<br>DGPNKGRQFHTCAKPREQQCGFFQWVDENTAPGTSGAPSWTGDRGRTLESEARSKRPRASSSDMGSTAKK<br>PRKCSLCHQPGHTRPFCPQNR (DNA topoisomerase III [Homo sapiens], CCDS 11194.1) |
| FEN1 | MGIQGLAKLIADVAPSAIRENDIKSYFGRKVAIDASMSIYQFLIAVRQGGDVLQNEEGET<br>TSHLMGMFYRTIRMMENGIKPVYVFDGKPPQLKSGELAKRSERRAEAEKQLQQAQAAGAE<br>QEVEKFTKRLVKVTKQHNDECKHLLSLMGIPYLDAPSEAEASCAALVKAGKVYAAATEDM<br>DCLTFGSPVLMRHLTASEAKKLPIQEFHLSRILQELGLNQEQFVDLCILLGSDYCESIRG<br>IGPKRAVDLIQKHKSIEEIVRRLDPNKYPVPENWLHKEAHQLFLEPEVLDPESVELKWSE<br>PNEEELIKFMCGEKQFSEERIRSGVKRLSKSRQGSTQGRLDDFFKVTGSLSSAKRKEPEP<br>KGSTKKKAKTGAAGKFKRGK (Fen1 CCDS 8010.1) |
| MUS81 | MAAPVRLGRKRPLPACPNPLFVRWLTEWRDEATRSRRRTRFVFQKALRSLRRYPLPLRSGKEAKILQHFG<br>DGLCRMLDERLQRHRTSGGDHAPDSPSGENSPAPQGRLAEVQDSSMPVPAQPKAGGSGSYWPARHSGARV<br>ILLVLYREHLNPNGHHFLTKEELLQRCAQKSPRVAPGSARPWPALRSLLHRNLVLRTHQPARYSLTPEGL<br>ELAQKLAESEGLSLLNVGIGPKEPPGEETAVPGAASAELASEAGVQQQPLELRPGEYRVLLCVDIGETRG<br>GGHRPELLRELQRLHVTHTVRKLHVGDFVWVAQETNPRDPANPGELVLDHIVERKRLDDLCSSIIDGRFR<br>EQKFRLKRCGLERRVYLVEEHGSVHNLSLPESTLLQAVTNTQVIDGFFVKRTADIKESAAYLALLTRGLQ<br>RLYQGHTLRSRPWGTPGNPESGAMTSPNPLCSLLTFSDFNAGAIKNKAQSVREVFARQLMQVRGVSGEKA<br>AALVDRYSTPASLLAAYDACATPKEQETLLSTIKCGRLQRNLGPALSRTLSQLYCSYGPLT (MUS81 endonuclease homolog (yeast), isoform CRA_b [Homo sapiens], CCDS 8115.1) |
| EME1 | MALKKSSPSLDSGDSDSEELPTFAFLKKEPSSTKRRQPEREEKIVVVDISDCEASCPPAPELFSPPVPEI<br>AETVTQTQPVRLLSSESEDEEEFIPLAQRLTCKFLTHKQLSPEDSSSPVKSVLDHQNNEGASCDWKKPFP<br>KIPEVPLHDTPERSAADNKDLILDPCCQLPAYLSTCPGQSSSLAVTKTNSDILPPQKKTKPSQKVQGRGS<br>HGCRQQRQARQKESTLRRQERKNAALVTRMKAQRPEECLKHIIVVLDPVLLQMEGGGQLLGALQTMECRC<br>VIEAQAVPCSVTWRRRAGPSEDREDWVEEPTVLVLLRAEAFVSMIDNGKQGSLDSTMKGKETLQGFVTDI<br>TAKTAGKALSLVIVDQEKCFSLELLFFDFLPCTSAQNPPRRGKQGANKQTKKQQQRQPEASIGSMVSRVD<br>AEEALVDLQLHTEAQAQIVQSWKELADFTCAFTKAVAEAPFKKLRDETTFSFCLESDWAGGVKVDLAGRG<br>LALVWRRQIQQLNRVSLEMASAVVNAYPSPQLLVQAYQQCFSDKERQNLLADIQVRRGEGVTSTSRRIGP<br>ELSRRIYLQMTTLQPHLSLDSAD (crossover junction endonuclease EME1 isoform 2 [Homo sapiens], CCDS 54141.1)<br>MALKKSSPSLDSGDSDSEELPTFAFLKKEPSSTKRRQPEREEKIVVVDISDCEASCPPAPELFSPPVPEI<br>AETVTQTQPVRLLSSESEDEEEFIPLAQRLTCKFLTHKQLSPEDSSSPVKSVLDHQNNEGASCDWKKPFP<br>KIPEVPLHDTPERSAADNKDLILDPCCQLPAYLSTCPGQSSSLAVTKTNSDILPPQKKTKPSQKVQGRGS<br>HGCRQQRQARQKESTLRRQERKNAALVTRMKAQRPEECLKHIIVVLDPVLLQMEGGGQLLGALQTMECRC<br>VIEAQAVPCSVTWRRRAGPSEDREDWVEEPTVLVLLRAEAFVSMIDNGKQGSLDSTMKGKETLQGFVTDI<br>TAKTAGKALSLVIVDQEKCFSAQNPPRRGKQGANKQTKKQQQRQPEASIGSMVSRVDAEEALVDLQLHTE<br>AQAQIVQSWKELADFTCAFTKAVAEAPFKKLRDETTFSFCLESDWAGGVKVDLAGRGLALVWRRQIQQLN<br>RVSLEMASAVVNAYPSPQLLVQAYQQCFSDKERQNLLADIQVRRGEGVTSTSRRIGPELSRRIYLQMTTL<br>QPHLSLDSAD (crossover junction endonuclease EME1 isoform 1 [Homo sapiens], CCDS 11565.1) |
| SLX1 | MGPAGVAARPGRFFGVYLLYCLNPRYRGRVYVGFIVNTARRVQQHNGGRKKGGAWRISGRGPWEMVLVVH<br>GFPSSVAALRFEWAWQHPHASRRLAHVGPRLRGETAFAFHLRVLAHMLRAPPWARLPLTLRWVRPDLRQD<br>LCLPPPPHVPLAFGPPPPQAPAPRRRAGPFDDAEPEPDQGDPGACCSLCAQTIQDEEGPLCCPHPGCLLR<br>AHVICLAEEFLQEEPGQLLPLEGQCPCCEKSLLWGDLIWLCQMDTEKEVEDSELEEAHWTDLLET (structure-specific endonuclease subunit SLX1 isoform 2 [Homo sapiens], CCDS 32431.1)<br>MGPAGVAARPGRFFGVYLLYCLNPRYRGRVYVGFIVNTARRVQQHNGGRKKGGAWRISGRGPWEMVLVVH<br>GFPSSVAALRDEEGPLCCPHPGCLLRAHVICLAEEFLQEEPGQLLPLEGQCPCCEKSLLWGDLIWLCQMD<br>TEKEVEDSELEEAHWTDLLET (structure-specific endonuclease subunit SLX1 isoform 1 [Homo sapiens], CCDS 32432.1) |
| SLX4 | MKLSVNEAQLGFYLGSLSHLSACPGIDPRSSEDQPESLKTGQMMDESDEDFKELCASFFQRVKKHGIKEV<br>SGERKTQKAASNGTQIRSKLKRTKQTATKTKTLQGPAEKKPPSGSQAPRTKKQRVTKWQASEPAHSVNGE<br>GGVLASAPDPPVLRETAQNTQTGNQQEPSPNLSREKTRENVPNSDSQPPPSCLTTAVPSPSKPRTAQLVL<br>QRMQQFKRADPERLRHASEECSLEAAREENVPKDPQEEMMAGNVYGLGPPAPESDAAVALTLQQEFARVG<br>ASAHDDSLEEKGLFFCQICQKNLSAMNVTRREQHVNRCLDEAEKTLRPSVPQIPECPICGKPFLTLKSRT<br>SHLKQCAVKMEVGPQLLLQAVRLQTAQPEGSSSPPMFSFSDHSRGLKRRGPTSKKEPRKRRKVDEAPSED<br>LLVAMALSRSEMEPGAAVPALRLESAFSERIRPEAENKSRKKKPPVSPPLLLVQDSETTGRQIEDRVALL<br>LSEEVELSSTPPLPASRILKEGWERAGQCPPPPERKQSFLWEGSALTGAWAMEDFYTARLVPPLVPQRPA<br>QGLMQEPVPPLVPPEHSELSERRSPALHGTPTAGCGSRGPSPSASQREHQALQDLVDLAREGLSASPWPG<br>SGGLAGSEGTAGLDVVPGGLPLIGFVVPSQDKHPDRGGRILLSLGLLVADFGAMVNNPHLSDVQFQTDSG<br>EVLYAHKFVLYARCPLLIQYVNNEGFSAVEDGVLTGLDVSTEAARTFLHYLYTADTGLPPGLSSEL<br>SSLAHRFGVSELVHLCEQVPIATDSEGKPWEEKEAENCESRAENFQELLRSMWADEEEEAETLLKSKDHE<br>EDQENVNEAEMEEIYEFAATQRKLLQEERAAGAGEDADWLEGGSPVSGQLLAGVQVQKQWDKVEEMEPLE<br>PGRDEAATTWEKMGQCALPPPQGQHSGARGAEAPEQEAPEEALGHSSCSSPSRDCQAERKEGSLPHSDDA<br>GDYEQLFSSTQGEISEPSQITSEPEEQSGAVRERGLEVSHRLAPWQASPPHPCRFLLGPPQGGSPRGSHH<br>TSGSSLSTPRSRGGTSQVGSPTLLSPAVPSKQKRDRSILTLSKEPGHQKGKERRSVLECRNKGVLMFPEK |

TABLE VI.2-continued

Factors that promote HDR

| Factor | Sequence |
|---|---|
| | SPSIDLTQSNPDHSSSRSQKSSSKLNEEDEVILLLDSDEELELEQTKMKSISSDPLEEKKALEISPRSCE LFSIIDVDADQEPSQSPPRSEAVLQQEDEGALPENRGSLGRRGAPWLFCDRESSPSEASTTDTSWLVPAT PLASRSRDCSSQTQISSLRSGLAVQAVTQHTPRASVGNREGNEVAQKFSVIRPQTPPPQTPSSCLTPVSP GTSDGRRQGHRSPSRPHPGGHPHSSPLAPHPISGDRAHFSRRFLKHSPPGPSFLNQTPAGEVVEVGDSDD EQEVASHQANRSPPLDSDPPIPIDDCCWHMEPLSPIPIDHWNLERTGPLSTSSPSRRMNEAADSRDCRSP GLLDTTPIRGSCTTQRKLQEKSSGAGSLGNSRPSFLNSALWDVWDGEEQRPPETPPPAQMPSAGGAQKPE GLETPKGANRKKNLPPKVPITPMPQYSIMETPVLKKELDRFGVRPLPKRQMVLKLKEIFQYTHQTLDSDS EDESQSSQPLLQAPHCQTLASQTYKPSRAGVHAQQEATTGPGAHRPKGPAKTKGPRHQRKHHESITPPSR SPTKEAPPGLNDDAQIPASQESVATSVDGSDSSLSSQSSSSCEFGAAFESAGEEEGEGEVSASQAAVQAA DTDEALRCYIRSKPALYQKVLLYQPFELRELQAELRQNGLRVSSRRLLDFLDTHCITFTTAATRREKLQG RRRQPRGKKKVERN (structure-specific endonuclease subunit SLX4 [Homo sapiens], CCDS 10506.2) |
| a FA protein | — |

In some embodiments, the methods described herein involve down-regulating one HDR pathway in order to promote another HDR pathway. For example, the SSA pathway may be down-regulated in order to promote HR and/or alt-HR. In another embodiment, the alt-HR pathway may be downregulated in order to promote HR and/or SSA. In another embodiment, the alt-HR pathway may be down-regulated to promote SSA and HR.

For instance, the methods may involve modulating, e.g., inhibiting, a component (e.g., exactly one component, or one or more components, e.g., two or three components) of the HDR pathway, e.g., a component of Table VI.1(C) or VI.2. More specifically, the methods may involve modulating, e.g., inhibiting, exactly one of, or one or more of a PARP, PARP1, PARP2, MRN complex, MRE11, RAD50, NBS1, ATM, BRCA2, BRCA1, BRCA1 complex, BRCA1-C complex, CtIP, EXO1, BLM, PP4, RAD51, FEN1, MUS81/EME1, SLX1/SLX4, and a FA protein. In some embodiments, one or more of alt-HR, anti-HR, NHEJ, MMEJ, SSA, SSBR, MMR, NER, and BER, are not substantially down-regulated, e.g., in some embodiments the only DNA damage repair pathway to be substantially down-regulated is one HDR pathway. In some embodiments, a PARP (e.g., a PARP which is involved in NHEJ and/or SSBr) is not down-regulated. In some embodiments, XRCC1 (e.g., involved in NER, alt-NHEJ, BER, and/or SSBr) is not down-regulated.

In some embodiments, RTEL is inhibited in order to promote HDR.

In some embodiments, an HDR pathway is down-regulated using an siRNA against a component of the pathway, e.g., BRCA2, BRCA1, or Rad51, or a Rad51 inhibitor such as B02, A03, AI-10, RI-1, RI-2, or IBR2, or an agent of Table VI.3, or any combination thereof. Down-regulation may result in enhanced alt-HR repair (see below). In some embodiments, an HDR pathway is down regulated using an HDR-enhancing gRNA that targets a component of the HDR pathway, e.g., BRCA2, BRCA1, or Rad51. In some embodiments, the HDR-enhancing gRNA is used in combination with an eiCas9 molecule. In some embodiments, the HDR-enhancing gRNA is used in combination with an eaCas9 molecule. In some embodiments, the HDR-enhancing gRNA is administered to the cell as a HDR-enhancing gRNA:Cas9 molecule complex.

TABLE VI.3

Down-regulators of HDR. (In this table and throughout this disclosure, when siRNAs are written with both upper-case and lower-case letters, the upper-case letters indicate ribonucleotides and the lower-case letters indicate deoxyribonucleotides.)

1. BRCA1

| siRNA | BRCA1 siRNA (h), sold by Santa Cruz Biotechnology; BRCA1 siRNA II, sold by Cell Signaling Technology | | | | |
|---|---|---|---|---|---|
| | Entrez Gene Symbol | Entrez Gene ID | GenBank Acc. No. | Reagent Source ID | Sequence (sense) |
| | BRCA1 | 672 | NM_007294 | D-003461-05 | CAGCUACCCUUCCAUCAUA |
| | BRCA1 | 672 | NM_007294 | D-003461-06 | GGGAUACCAUGCAACAUAA |
| | BRCA1 | 672 | NM_007294 | D-003461-07 | GAAGGAGCUUUCAUCAUUC |
| | BRCA1 | 672 | NM_007294 | D-003461-08 | CUAGAAAUCUGUUGCUAUG |
| | BRCA1 | 672 | NM_007294 | s224683 | UUCUUUAAUAGACUGGGUCac |
| | BRCA1 | 672 | NM_007294 | s458 | UAUGAUGGAAGGGUAGCUGtt |
| | BRCA1 | 672 | NM_007294 | s459 | UAUCAGGUUAUGUUGCAUGgt |
| antibodies | BRCA1 (D-9) antibody, sold by Santa Cruz Biotechnology; BRCA1 (D-20) antibody, sold by Santa Cruz Biotechnology; BRCA1 (GLK-2) antibody, sold by Santa Cruz Biotechnology; | | | | |

TABLE VI.3-continued

Down-regulators of HDR. (In this table and throughout this disclosure, when siRNAs are written with both upper-case and lower-case letters, the upper-case letters indicate ribonucleotides and the lower-case letters indicate deoxyribonucleotides.)

BRCA1 (C-20) antibody, sold by Santa Cruz Biotechnology;
BRCA1 (287.17) antibody, sold by Santa Cruz Biotechnology;
BRCA1 antibody, sold by Cell Signaling Technology

2. BRCA2

| | | | | | |
|---|---|---|---|---|---|
| siRNA | BRCA2 silencer # 121226, sold by Life Technologies; BRCA2-set siRNA/shRNA/RNAi Lentivector, sold by ABM | | | | |
| | Entrez Gene Symbol | Entrez Gene ID | GenBank Acc. No. | Reagent Source ID | Sequence (sense) |
| | BRCA2 | 675 | NM_000059 | D-003462-01 | GAAACGGACUUGCUAUUUA |
| | BRCA2 | 675 | NM_000059 | D-003462-02 | GUAAAGAAAUGCAGAAUUC |
| | BRCA2 | 675 | NM_000059 | D-003462-03 | GGUAUCAGAUGCUUCAUUA |
| | BRCA2 | 675 | NM_000059 | D-003462-04 | GAAGAAUGCAGGUUUAAUA |
| | BRCA2 | 675 | NM_000059 | s2083 | UUCCGUUUAAUUUCAACUGta |
| | BRCA2 | 675 | NM_000059 | s2084 | UUGCGAAAUAUGUAUAAUCca |
| | BRCA2 | 675 | NM_000059 | s224695 | UACGUUUUUAGGUGAAGCCtg |
| antibodies | Anti-BRCA2 antibody (ab27976), sold by Abcam; Anti-BRCA2 antibody (ab9143), sold by Abcam; Anti-BRCA2 antibody (ab123491), sold by Abcam | | | | |

3. Rad51

| | | | | | |
|---|---|---|---|---|---|
| siRNA | Rad51 siRNA (m), sold by Santa Cruz Biotechnology siRNA from siRNA plasmid, pKD-Rad51-v1, sold by EMD Millipore | | | | |
| | Entrez Gene Symbol | Entrez Gene ID | GenBank Acc. No. | Reagent Source ID | Sequence (sense) |
| | RAD51 | 5888 | NM_002875 | D-003530-05 | GCAGUGAUGUCCUGGAUAA |
| | RAD51 | 5888 | NM_002875 | D-003530-07 | CCAACGAUGUGAAGAAAUU |
| | RAD51 | 5888 | NM_002875 | D-003530-08 | AAGCUAUGUUCGCCAUUAA |
| | RAD51 | 5888 | NM_002875 | s11734 | UGCAUACCUAGAUUCUACCat |
| | RAD51 | 5888 | NM_002875 | s11735 | UGAUUAGUGAUUACCACUGct |
| | RAD51 | 5888 | NM_002875 | s11736 | UGCUUGAUAAAGGAGCUGGgt |
| Antibodies | RAD51 mouse monoclonal antibody (clone 3C10), sold by Life Technologies; Rad51 (3C10) antibody, sold by Santa Cruz Biotechnology; Rad51 (F-11) antibody, sold by Santa Cruz Biotechnology; Rad51 (G-9) antibody, sold by Santa Cruz Biotechnology; | | | | |

| Compounds | |
|---|---|
| B02 | Huang et al. (2011) ACS CHEM. BIOL. 6(6): 628-35. |
| A03 | Huang et al. (2011) ACS CHEM. BIOL. 6(6): 628-35. |
| RI-1 | Budke et al. (2012) NUCLEIC ACIDS RES. 40(15): 7347-57. |
| IBR2 | Zhu et al. (2013) EMBO MOL. MED. 5(3): 353-65. |

HDR and the Cell Cycle

HDR is highly influenced by the stage of the cell cycle. Cell cycle regulation acts on several points of the pathway, which are discussed below.

First, in the wild-type context, HDR is thought to be limited to S and G2 phase because HDR requires RAD51 to interact with the C-terminus of BRCA2, and this interaction only occurs during S and G2 phases.

In addition, cell cycle-dependent differences in resection may help limit homologous recombination to S/G2. In mammals, to promote HDR, the resecting endonuclease CtIP is activated by CDK phosphorylation at threonine 847. A further phosphorylation on serine 327 promotes CtIP's interaction with the BRCT domain of BRCA1 (which is important for HDR). In a mutually antagonistic arrangement, BRCA1-CtIP favors homologous recombination by antagonizing 53BP1-RIF1 in G2, whereas in G1, 53BP1-RIF2 blocks BRCA1 from accumulating at DSBs. Resection involves not only nucleases but helicases. Helicases are motor proteins that move along the backbone of the DNA and alter the structure of DNA by unwinding DNA or promoting the annealing of single strands. Unwinding of the DNA occurs through an ATP-dependent process that breaks the hydrogen bonds between the nucleotides of annealed strands, e.g., through ATP hydrolysis. Unwinding activity can occur in the 5' to 3' direction or in the 3' to 5' direction. Helicase activity also includes promoting ATP-independent or ATP-dependent annealing of two single strands with significant or sufficient complementarity. The helicase BLM also undergoes cell-cycle dependent regulation. More particularly, sumoylation of BLM appears to promote recombination.

The stage of the cell cycle also affects the formation of the RAD51 filament. For instance, RPA (which forms a substrate for assembly of the RAD51 filament) is phosphorylated in a cell cycle dependent manner, affecting its ability to localize properly. In addition, RAD51 is more directly regulated; the CHK1 kinase phosphorylates it, allowing it to form foci at the sites of DNA damage and promote repair. As an additional form of regulation, CDK-cyclin A phosphorylates BRCA2 in M phase, preventing BRCA2 from interacting with RAD51, effectively shutting down HDR at the end of G2 phase.

In addition, the MRN complex may also be a target of cell cycle dependent regulation.

VI.2 Antirecombinant Factors

The anti-homologous recombination (anti-HR) pathway is an HDR pathway and involves helicases that disrupt RAD51 ssDNA filaments. In mammals, the helicase FBH1 is thought to prevent RAD51 from localizing to breaks (e.g., by replacing Rad51 on a filament), thereby suppressing HDR. FBH1's role may be to prevent spontaneous synthesis dependent strand annealing that initiates inappropriately. A second helicase, RECQ5, that has a 3' to 5' activity, can suppress HDR by binding RAD51 and displacing it from the ssDNA. A third helicase, BLM, can also bind RAD51 and disrupt RAD51 ssDNA filaments. BLM and RECQ5 are both members of the RecQ helicase family and act in the 3' to 5' direction. A fourth helicase, FANCJ, acts in the 5' to 3' direction and can disrupt RAD51 ssDNA filaments. A fifth anti-recombination helicase is WRN (Werner). A sixth protein, PARI, has a helicase domain but lacks Walker A and B motifs, so it may not be an active helicase. PARI can replace a Rad51 filament in vitro. Lastly, RTEL has been shown to displace Rad51. Regulator of telomere elongation helicase (RTEL or RTEL1) has ATP-dependent 5' to 3' DNA helicase activity.

Another class of anti-recombination factors disrupts D-loops. These factors include RECQ1, BLM, and WRN.

Rap80 also acts against homologous recombination. The BRCA1-RAP80 complex restricts end resection in S/G(2) phase of the cell cycle, thereby limiting HDR. It recruits the BRCA1 A complex and that prevents the repair throughout HR (see Hu Y. et al. (2011) GENES DEV. 25(7): 685-700; and Coleman and Greenberg (2011) J. BIOL. CHEM. 286(15): 13669-80.

Several miRNAs are also involved in anti-HR: miR-545 (which downregulates BRCA1 and opposes Rad51 focus formation), miR-107 and miR-155 (which downregulate Rad51), miR-1255 (which downregulates BRCA1 and BRCA2), miR-148 (which downregulates Rad51, especially in G1), and miR-193 (which downregulates BRCA1, BRCA2, and Rad51). Anti-miRs can increase the levels of homologous repair factors in G1.

In one embodiment, HDR repair pathways can be promoted by down-regulating the antirecombinant factors of the anti-HR pathway. For example, in one embodiment, a Cas9 molecule and gRNA can induce a DSB in a desired location during G2 or another phase of the cycle. This DSB can be formed using, e.g., one Cas9 molecule with the ability to produce DSBs, or two nickases. A template nucleic acid can be added to the cell, so that the HDR machinery repairs the DSB using the template nucleic acid. During the S/G2 phase, an anti-HR inhibitor, as described herein, can prevent unproductive resolution of the HDR intermediate.

Accordingly, in some embodiments, the methods herein involve down-regulating the anti-HR pathway in order to promote HDR. For instance, the methods may involve modulating, e.g., inhibiting, a component (e.g., exactly one component, or one or more components, e.g., two or three components) of the anti-HR pathway, e.g., a component of Table VI.1(D) or Table VI.4. More specifically, the methods may involve modulating, e.g., inhibiting, exactly one of, or one or more of an anti-HR helicase, FBH1, RECQ5, BLM, a RecQ helicase, PARI, Rap80, FANCJ, FANCM, RECQ1, or RAD54. In embodiments, one or more of HDR, alt-HR, NHEJ, MMEJ, SSA, SSBR, MMR, NER, and BER are not substantially down-regulated, e.g., in some embodiments the only DNA damage repair pathway to be substantially down-regulated is the anti-HR pathway.

TABLE VI.4

Factors that promote anti-HR.

| Factor | Sequence |
| --- | --- |
| an anti-HR helicase | — |
| FBH1 | >sp\|Q8NFZ0\|FBX18_HUMAN F-box only<br>protein 18 OS = Homo sapiens GN = FBXO18 PE = 1 SV = 2<br>MRRFKRKHLTAIDCQHLARSHLAVTQPFGQRWTNRDPNHGLYPKPRTKRGSRGQGSQRCI<br>PEFFLAGKQPCTNDMAKSNSVGQDSCQDSEGDMIFPAESSCALPQEGSAGPGSPGSAPPS<br>RKRSWSSEEESNQATGTSRWDGVSKKAPRHHLSVPCTRPREARQEAEDSTSRLSAESGET<br>DQDAGDVGPDPIPDSYYGLLGTLPCQEALSHICSLPSEVLRHVFAFLPVEDLYWNLSLVC<br>HLWREIISDPLFIPWKKLYHRYLMNEEQAVSKVDGILSNCGIEKESDLCVLNLIRYTATT<br>KCSPSVDPERVLWSLRDHPLLPEAEACVRQHLPDLYAAAGGVNIWALVAAVVLLSSSVND<br>IQRLLFCLRRPSSTVTMPDVTFTLYCIAVLLYAMREKGINISNRIHYNIFYCLYLQENSC<br>TQATKVKEEPSVWPGKKTIQLTHEQQLILNHKMEPLQVVKIMAFAGTGKTSTLVKYAEKW<br>SQSRFLYVTFNKSIAKQAERVFPSNVICKTFHSMAYGHIGRKYQSKKKLNLFKLTPFMVN<br>SVLAEGKGGFIRAKLVCKTLENFFASADEELTIDHVPIWCKNSQGQRVMVEQSEKLNGVL<br>EASRLWDNMRKLGECTEEAHQMTHDGYLKLWQLSKPSLASFDAIFVDEAQDCTPAIMNIV<br>LSQPCGKIFVGDPHQQIYTFRGAVNALFTVPHTHVFYLTQSFRFGVEIAYVGATILDVCK<br>RVRKKTLVGGNHQSGIRGDAKGQVALLSRTNANVFDEAVRVTEGEFPSRIHLIGGIKSFG<br>LDRIIDIWILLQPEEERRKQNLVIKDKFIRRWVHKEGFSGFKRYVTAAEDKELEAKIAVV<br>EKYNIRIPELVQRIEKCHIEDLDFAEYILGTVHKAKGLEFDTVHVLDDFVKVPCARHNLP<br>QLPHFRVESFSEDEWNLLYVAVTRAKKRLIMTKSLENILTLAGEYFLQAELTSNVLKTGV<br>VRCCVGQCNNAIPVDTVLTMKKLPITYSNRKENKGGYLCHSCAEQRIGPLAFLTASPEQV<br>RAMERTVENIVLPRHEALLFLVF |

TABLE VI.4-continued

Factors that promote anti-HR.

| Factor | Sequence |
| --- | --- |
| RECQ5 | See Table VI.2 |
| BLM | See Table VI.2 |
| FANCJ | See Table VI.2 |
| PARI | >sp\|Q9NWS1\|PARI_HUMAN PCNA-interacting partner OS = *Homo sapiens* GN = PARPBP PE = 1 SV = 3<br>MAVFNQKSVSDMIKEFRKNWRALCNSERTTLCGADSMLLALQLSMAENNKQHSGEFTVSL<br>SDVLLTWKYLLHEKLNLPVENMDVTDHYEDVRKIYDDFLKNSNMLDLIDVYQKCRALTSN<br>CENYNTVSPSQLLDFLSGKQYAVGDETDLSIPTSPTSKYNRDNEKVQLLARKIIFSYLNL<br>LVNSKNDLAVAYILNIPDRGLGREAFTDLKHAAREKQMSIFLVATSFIRTIELGGKGYAP<br>PPSDPLRTHVKGLSNFINFIDKLDEILGEIPNPSIAGGQILSVIKMQLIKGQNSRDPFCK<br>AIEEVAQDLDLRIKNIINSQEGVVALSTTDISPARPKSHAINHGTAYCGRDTVKALLVLL<br>DEEAANAPTKNKAELLYDEENTIHHHGTSILTLFRSPTQVNNSIKPLRERICVSMQEKKI<br>KMKQTLIRSQFACTYKDDYMISKDNWNNVNLASKPLCVLYMENDLSEGVNPSVGRSTIGT<br>SFGNVHLDRSKNEKVSRKSTSQTGNKSSKRKQVDLDGENILCDNRNEPPQHKNAKIPKKS<br>NDSQNRLYGKLAKVAKSNKCTAKDKLISGQAKLTQFFRL<br>>sp\|Q9NWS1\|PARI_HUMAN PCNA-interacting partner<br>OS = *Homo sapiens* GN = PARPBP PE = 1 SV = 3<br>MAVFNQKSVSDMIKEFRKNWRALCNSERTTLCGADSMLLALQLSMAENNKQHSGEFTVSL<br>SDVLLTWKYLLHEKLNLPVENMDVTDHYEDVRKIYDDFLKNSNMLDLIDVYQKCRALTSN<br>CENYNTVSPSQLLDFLSGKQYAVGDETDLSIPTSPTSKYNRDNEKVQLLARKIIFSYLNL<br>LVNSKNDLAVAYILNIPDRGLGREAFTDLKHAAREKQMSIFLVATSFIRTIELGGKGYAP<br>PPSDPLRTHVKGLSNFINFIDKLDEILGEIPNPSIAGGQILSVIKMQLIKGQNSRDPFCK<br>AIEEVAQDLDLRIKNIINSQEGVVALSTTDISPARPKSHAINHGTAYCGRDTVKALLVLL<br>DEEAANAPTKNKAELLYDEENTIHHHGTSILTLFRSPIQVNNSIKPLRERICVSMQEKKI<br>KMKQTLIRSQFACTYKDDYMISKDNWNNVNLASKPLCVLYMENDLSEGVNPSVGRSTTGT<br>SFGNVHLDRSKNEKVSRKSTSQTGNKSSKRKQVDLDGENILCDNRNEPPQHKNAKIPKKS<br>NDSQNRLYGKLAKVAKSNKCTAKDKLISGQAKLTQFFRL<br>>sp\|Q9NWS1-2\|PARI_HUMAN Isoform 2 of PCNA-interacting partner OS = *Homo sapiens* GN = PARPBP<br>MDVIDHYEDVRKIYDDFLKNSNMLDLIDVYQKCRALTSNCENYNTVSPSQLLDFLSGKQY<br>AVGDETDLSIPTSPISKYNRDNEKVQLLARKIIFSYLNLLVNSKNDLAVAYILNIPDRGL<br>GREAFTDLKHAAREKQMSIFLVATSFIRTIELGGKGYAPPPSDPLRTHVKGLSNFINFID<br>KLDEILGEIPNPSIAGGQILSVIKMQLIKGQNSRDPFCKAIEEVAQDLDLRIKNIINSQE<br>GVVALSTIDISPARPKSHAINHGTAYCGRDTVKALLVLLDEEAANAPTKNKAELLYDEEN<br>TIHHHGTSILTLFRSPIQVNNSIKPLRERICVSMQEKKIKMKQTLIRSQFACTYKDDYMI<br>SKDNWNNVNLASKPLCVLYMENDLSEGVNPSVGRSTIGTSFGNVHLDRSKNEKVSRKSTS<br>QTGNKSSKRKQVDLDGENILCDNRNEPPQHKNAKIPKKSNDSQNRLYGKLAKVAKSNKCT<br>AKDKLISGQAKLTQFFRL<br>>sp\|Q9NWS1-3\|PARI_HUMAN Isoform 3 of PCNA-interacting partner OS = *Homo sapiens* GN = PARPBP<br>MAVFNQKSVSDMIKEFRKNWRALCNSERTTLCGADSMLLALQLSMAENNKQHSGEFTVSL<br>SDVLLTWKYLLHEKLNLPVENMDVIDHYEDVRKIYDDFLKNSNMLDLIDVYQKCRALTSN<br>CENYNTVSPSQLLDFLSGKQYAVGDETDLSIPTSPISKYNRDNEKALPVLKR<br>>sp\|Q9NWS1-4\|PARI_HUMAN Isoform 4 of PCNA-interacting partner OS = *Homo sapiens* GN = PARPBP<br>MAVFNQKSVSDMIKEFRKNWRALCNSERTTLCGADSMLLALQLSMAENNKQHSGEFTVSL<br>SDVLLTWKYLLHEKLNLPVENMDVIDHYEDVRKIYDDFLKNSNMLDLIDVYQKCRALTSN<br>CENYNTVSPVSIF<br>>sp\|Q9NWS1-5\|PARI_HUMAN Isoform 5 of PCNA-interacting partner OS = *Homo sapiens* GN = PARPBP<br>MQLIKGQNSRDPFCKAIEEVAQDLDLRIKNIINSQEGVVALSTIDISPARPKSHAINHGT<br>AYCGRDTVKALLVLLDEEAANAPTKNKAELLYDEENTIHHHGTSILTLFRSPIQVNNSIK<br>PLRERICVSMQEKKIKMKQTLIRSQFACTYKDDYMISKDNWNNVNLASKPLCVLYMENDL<br>SEGVNPSVGRSTIGTSFGNVHLDRSKNEKVSRKSTSQTGNKSSKRKQVDLDGENILCDNR<br>NEPPQHKNAKIPKKSNDSQNRLYGKLAKVAKSNKCIAKDKLISGQAKLTQFFRL<br>>sp\|Q9NWS1-6\|PARI_HUMAN Isoform 6 of PCNA-interacting partner OS = *Homo sapiens* GN = PARPBP<br>MAVFNQKSVSDMIKEFRKNWRALCNSERTTLCGADSMLLALQLSMAENNKQHSGEFTVSL<br>SDVLLTWKYLLHEKLNLPVENMDVIDHYEDVRKIYDDFLKNSNMLDLIDVYQKCRALTSN<br>CENYNTVSPSQLLDFLSGKQYAVGDETDLSIPTSPISKYNRDNEKVQLLARKIIFSYLNL<br>LVNSKNDLAVAYILNIPDRGLGREAFTDLKHAAREKQMSIFLVATSFIRTIELGGKGYAP<br>PPSDPLRTHVKGLSNFINFIDKLDEILGEIPNPRGCKSICWKINNWNEFWKCSSGQK<br>>sp\|Q9NWS1-7\|PARI_HUMAN Isoform 7 of PCNA-interacting partner OS = *Homo sapiens* GN = PARPBP<br>MAVFNQKSVSDMIKEFRKNWRALCNSERTTLCGADSMLLALQLSMAENNKQHSGEFTVSL<br>SDVLLTWKYLLHEKLNLPVENMDVTDHYEDVRKIYDDFLKNSNMLDLIDVYQKCRALTSN<br>CENYNTVSPSQLLDFLSGKQYAVGDETDLSIPTSPTSKYNRDNEKVQLLARKIIFSYLNL<br>LVNSKNDLAVAYILNIPDRGLGREAFTDLKHAAREKQMSIFLVATSFIRTIELGGKGYAP<br>PPSDPLRTHVKGLSNFINFIDKLDEILGEIPNPRSPTQVNNSIKPLRERICVSMQEKKIK<br>RV |
| RECQ1 | See Table VI.2 |

TABLE VI.4-continued

Factors that promote anti-HR.

| Factor | Sequence |
| --- | --- |
| WRN | See Table VI.2 |
| RTEL | MPKIVLNGVTVDFPFQPYKCQQEYMTKVLECLQQKVNGILESPTGTGKTLCLLCTTLAWR
EHLRDGISARKIAERAQGELFPDRALSSWGNAAAAAGDPIACYTDIPKIIYASRTHSQLT
QVINELRNTSYRPKVCVLGSREQLCIHPEVKKQESNHLQIHLCRKKVASRSCHFYNNVEE
KSLEQELASPILDIEDLVKSGSKHRVCPYYLSRNLKQQADIIFMPYNYLLDAKSRRAHNI
DLKGTVVIFDEAHNVEKMCEESASFDLTPHDLASGLDVIDQVLEEQTKAAQQGEPHPEFS
ADSPSPGLNMELEDIAKLKMILLRLEGAIDAVELPGDDSGVTKPGSYIFELFAEAQITFQ
TKGCILDSLDQIIQHLAGRAGVFTNTAGLQKLADIIQIVFSVDPSEGSPGSPAGLGALQS
YKVHIHPDAGHRRTAQRSDAWSTTAARKRGKVLSYWCFSPGHSMHELVRQGVRSLILTSG
TLAPVSSFALEMQIPFPVCLENPHIIDKHQIWVGVVPRGPDGAQLSSAFDRRFSEECLSS
LGKALGNIARVVPYGLLIFFPSYPVMEKSLEFWRARDLARKMEALKPLFVEPRSKGSFSE
TISAYYARVAAPGSTGATFLAVCRGKASEGLDFSDTNGRGVIVTGLPYPPRMDPRVVLKM
QFLDEMKGQGGAGGQFLSGQEWYRQQASRAVNQAIGRVIRHRQDYGAVFLCDHRFAFADA
RAQLPSWVRPHVRVYDNFGHVIRDVAQFFRVAERTMPAPAPRATAPSVRGEDAVSEAKSP
GPFFSTRKAKSLDLHVPSLKQRSSGSPAAGDPESSLCVEYEQEPVPARQRPRGLLAALEH
SEQRAGSPGEEQAHSCSTLSLLSEKRPAEEPRGGRKKIRLVSHPEEPVAGAQTDRAKLFM
VAVKQELSQANFATFTQALQDYKGSDDFAALAACLGPLFAEDPKKHNLLQGFYQFVRPHH
KQQFEEVCIQLTGRGCGYRPEHSIPRRQRAQPVLDPTGRTAPDPKLTVSTAAAQQLDPQE
HLNQGRPHLSPRPPPTGDPGSQPQWGSGVPRAGKQGQHAVSAYLADARRALGSAGCSQLL
AALTAYKQDDDLDKVLAVLAALTTAKPEDFPLLHRFSMFVRPHHKQRFSQICIDLIGRPY
PGMEPPGPQEERLAVPPVLTHRAPQPGPSRSEKTGKTQSKISSFLRQRPAGTVGAGGEDA
GPSQSSGPPHGPAASEWGL (RTEL Isoform 1 CCDS 13531.1)
MPKIVLNGVTVDFPFQPYKCQQEYMTKVLECLQQKVNGILESPTGTGKTLCLLCTTLAWR
EHLRDGISARKIAERAQGELFPDRALSSWGNAAAAAGDPIACYTDIPKIIYASRTHSQLT
QVINELRNTSYRSRCRATLWVLETAPPRPTVLSPIRPKVCVLGSREQLCIHPEVKKQESN
HLQIHLCRKKVASRSCHFYNNVEEKSLEQELASPILDIEDLVKSGSKHRVCPYYLSRNLK
QQADIIFMPYNYLLDAKSRRAHNIDLKGTVVIFDEAHNVEKMCEESASFDLTPHDLASGL
DVIDQVLEEQTKAAQQGEPHPEFSADSPSPGLNMELEDIAKLKMILLRLEGAIDAVELPG
DDSGVTKPGSYIFELFAEAQITFQTKGCILDSLDQIIQHLAGRAGVFTNTAGLQKLADII
QIVFSVDPSEGSPGSPAGLGALQSYKVHIHPDAGHRRTAQRSDAWSTTAARKRGKVLSYW
CFSPGHSMHELVRQGVRSLILTSGTLAPVSSFALEMQIPFPVCLENPHIIDKHQIWVGVV
PRGPDGAQLSSAFDRRFSEECLSSLGKALGNIARVVPYGLLIFFPSYPVMEKSLEFWRAR
DLARKMEALKPLFVEPRSKGSFSETISAYYARVAAPGSTGATFLAVCRGKASEGLDFSDT
NGRGVIVTGLPYPPRMDPRVVLKMQFLDEMKGQGGAGGQFLSGQEWYRQQASRAVNQAIG
RVIRHRQDYGAVFLCDHRFAFADARAQLPSWVRPHVRVYDNFGHVIRDVAQFFRVAERTM
PAPAPRATAPSVRGEDAVSEAKSPGPFFSTRKAKSLDLHVPSLKQRSSGSPAAGDPESSL
CVEYEQEPVPARQRPRGLLAALEHSEQRAGSPGEEQAHSCSTLSLLSEKRPAEEPRGGRK
KIRLVSHPEEPVAGAQTDRAKLFMVAVKQELSQANFATFTQALQDYKGSDDFAALAACLG
PLFAEDPKKHNLLQGFYQFVRPHHKQQFEEVCIQLTGRGCGYRPEHSIPRRQRAQPVLDP
TGRTAPDPKLTVSTAAAQQLDPQEHLNQGRPHLSPRPPPTGDPGSQPQWGSGVPRAGKQG
QHAVSAYLADARRALGSAGCSQLLAALTAYKQDDDLDKVLAVLAALTTAKPEDFPLLHRF
SMFVRPHHKQRFSQICIDLIGRPYPGMEPPGPQEERLAVPPVLTHRAPQPGPSRSEKTGK
TQSKISSFLRQRPAGTVGAGGEDAGPSQSSGPPHGPAASEWGL (RTEL Isoform 2
CCDS 13530.3)
MPKIVLNGVTVDFPFQPYKCQQEYMTKVLECLQQKVNGILESPTGTGKTLCLLCTTLAWR
EHLRDGISARKIAERAQGELFPDRALSSWGNAAAAAGDPIACYTDIPKIIYASRTHSQLT
QVINELRNTSYRPKVCVLGSREQLCIHPEVKKQESNHLQIHLCRKKVASRSCHFYNNVEE
KSLEQELASPILDIEDLVKSGSKHRVCPYYLSRNLKQQADIIFMPYNYLLDAKSRRAHNI
DLKGTVVIFDEAHNVEKMCEESASFDLTPHDLASGLDVIDQVLEEQTKAAQQGEPHPEFS
ADSPSPGLNMELEDIAKLKMILLRLEGAIDAVELPGDDSGVTKPGSYIFELFAEAQITFQ
TKGCILDSLDQIIQHLAGRAGVFTNTAGLQKLADIIQIVFSVDPSEGSPGSPAGLGALQS
YKVHIHPDAGHRRTAQRSDAWSTTAARKRGKVLSYWCFSPGHSMHELVRQGVRSLILTSG
TLAPVSSFALEMQIPFPVCLENPHIIDKHQIWVGVVPRGPDGAQLSSAFDRRFSEECLSS
LGKALGNIARVVPYGLLIFFPSYPVMEKSLEFWRARDLARKMEALKPLFVEPRSKGSFSE
TISAYYARVAAPGSTGATFLAVCRGKASEGLDFSDTNGRGVIVTGLPYPPRMDPRVVLKM
QFLDEMKGQGGAGGQFLSGQEWYRQQASRAVNQAIGRVIRHRQDYGAVFLCDHRFAFADA
RAQLPSWVRPHVRVYDNFGHVIRDVAQFFRVAERTMPAPAPRATAPSVRGEDAVSEAKSP
GPFFSTRKAKSLDLHVPSLKQRSSGSPAAGDPESSLCVEYEQEPVPARQRPRGLLAALEH
SEQRAGSPGEEQAHSCSTLSLLSEKRPAEEPRGGRKKIRLVSHPEEPVAGAQTDRAKLFM
VAVKQELSQANFATFTQALQDYKGSDDFAALAACLGPLFAEDPKKHNLLQGFYQFVRPHH
KQQFEEVCIQLTGRGCGYRPEHSIPRRQRAQPVLDPTGRTAPDPKLTVSTAAAQQLDPQE
HLNQGRPHLSPRPPPTGDPGSQPQWGSGVPRAGKQGQHAVSAYLADARRALGSAGCSQLL
AALTAYKQDDDLDKVLAVLAALTTAKPEDFPLLHRFSMFVRPHHKQRFSQTCTDLTGRPY
PGMEPPGPQEERLAVPPVLTHRAPQPGPSRSEKTGKTQSKISSFLRQRPAGTVGAGGEDA
GPSQSSGPPHGPAASEWGEPHGRDIAGQQATGAPGGPLSAGCVCQGCGAEDVVPFQCPAC
DFQRCQACWQRHLQASRMCPACHTASRKQSVMQVFWPEPQ (RTEL Isoform 3
CCDS 63331.1)
MPYNYLLDAKSRRAHNIDLKGTVVIFDEAHNVEKMCEESASFDLTPHDLASGLDVIDQVL
EEQTKAAQQGEPHPEFSADSPSPGLNMELEDIAKLKMILLRLEGAIDAVELPGDDSGVTK
PGSYIFELFAEAQITFQTKGCILDSLDQIIQHLAGRAGVFTNTAGLQKLADIIQIVFSVD
PSEGSPGSPAGLGALQSYKVHIHPDAGHRRTAQRSDAWSTTAARKRGKVLSYWCFSPGHS
MHELVRQGVRSLILTSGTLAPVSSFALEMQIPFPVCLENPHIIDKHQIWVGVVPRGPDGA
QLSSAFDRRFSEECLSSLGKALGNIARVVPYGLLIFFPSYPVMEKSLEFWRARDLARKME
ALKPLFVEPRSKGSFSETISAYYARVAAPGSTGATFLAVCRGKASEGLDFSDTNGRGVIV |

TABLE VI.4-continued

Factors that promote anti-HR.

| Factor | Sequence |
|---|---|
| | TGLPYPPRMDPRVVLKMQFLDEMKGQGGAGGQFLSGQEWYRQQASRAVNQAIGRVIRHRQ<br>DYGAVFLCDHRFAFADARAQLPSWVRPHVRVYDNFGHVIRDVAQFFRVAERTMPAPAPRA<br>TAPSVRGEDAVSEAKSPGPFFSTRKAKSLDLHVPSLKQRSSGSPAAGDPESSLCVEYEQE<br>PVPARQRPRGLLAALEHSEQRAGSPGEEQAHSCSTLSLLSEKRPAEEPRGGRKKIRLVSH<br>PEEPVAGAQTDRAKLFMVAVKQELSQANFATFTQALQDYKGSDDFAALAACLGPLFAEDP<br>KKHNLLQGFYQFVRPHHKQQFEEVCIQLTGRGCGYRPEHSIPRRQRAQPVLDPTGRTAPD<br>PKLTVSTAAAQQLDPQEHLNQGRPHLSPRPPPTGDPGSQPQWGSGVPRAGKQGQHAVSAY<br>LADARRALGSAGCSQLLAALTAYKQDDDLDKVLAVLAALTTAKPEDFPLLHRFSMFVRPH<br>HKQRFSQTCTDLTGRPYPGMEPPGPQEERLAVPPVLTHRAPQPGPSRSEKTGKTQSKISS<br>FLRQRPAGTVGAGGEDAGPSQSSGPPHGPAASEWGL (RTEL Isoform 4 CCDS<br>74751.1) |
| Rap80 | >sp\|Q96RL1\|UIMC1_HUMAN BRCA1-A complex<br>subunit RAP80 OS = Homo sapiens GN = UIMC1 PE = 1 SV = 2<br>MPRRKKKVKEVSESRNLEKKDVETTSSVSVKRKRRLEDAFIVISDSDGEEPKEENGLQKT<br>KTKQSNRAKCLAKRKIAQMTEEEQFALALKMSEQEAREVNSQEEEEEELLRKAIAESLNS<br>CRPSDASATRSRPLATGPSSQHQEKTTDSGLTEGIWQLVPPSLFKGSHISQGNEAEERE<br>EPWDHTEKTEEEPVSGSSGSWDQSSQPVFENVNVKSFDRCTGHSAEHTQCGKPQESTGRG<br>SAFLKAVQGSGDTSRHCLPTLADAKGLQDTGGTVNYFWGIPFCPDGVDPNQYTKVILCQL<br>EVYQKSLKMAQRQLLNKKGFGEPVLPRPPSLIQNECGQGEQASEKNECISEDMGDEDKEE<br>RQESRASDWHSKTKDFQESSIKSLKEKLLLEEEPTTSHGQSSQGIVEETSEEGNSVPASQ<br>SVAALTSKRSLVLMPESSAEEITVCPETQLSSSETFDLEREVSPGSRDILDGVRIIMADK<br>EVGNKEDAEKEVAISTFSSSNQVSCPLCDQCFPPTKIERHAMYCNGLMEEDTVLIRRQKE<br>AKTKSDSGTAAQTSLDIDKNEKCYLCKSLVPFREYQCHVDSCLQLAKADQGDGPEGSGRA<br>CSTVEGKWQQRLKNPKEKGHSEGRLLSFLEQSEHKTSDADIKSSETGAFRVPSPGMEEAG<br>CSREMQSSFTRRDLNESPVKSFVSISEATDCLVDFKKQVTVQPGSRTRTKAGRGRRRKF<br>>sp\|Q96RL1\|UIMC1_HUMAN BRCA1-A complex<br>subunit RAP80 OS = Homo sapiens GN = UIMC1 PE = 1 SV = 2<br>MPRRKKKVKEVSESRNLEKKDVETTSSVSVKRKRRLEDAFIVISDSDGEEPKEENGLQKT<br>KTKQSNRAKCLAKRKIAQMTEEEQFALALKMSEQEAREVNSQEEEEEELLRKAIAESLNS<br>CRPSDASATRSRPLATGPSSQHQEKTTDSGLTEGIWQLVPPSLFKGSHISQGNEAEERE<br>EPWDHTEKTEEEPVSGSSGSWDQSSQPVFENVNVKSFDRCTGHSAEHTQCGKPQESTGRG<br>SAFLKAVQGSGDTSRHCLPTLADAKGLQDTGGTVNYFWGIPFCPDGVDPNQYTKVILCQL<br>EVYQKSLKMAQRQLLNKKGFGEPVLPRPPSLIQNECGQGEQASEKNECISEDMGDEDKEE<br>RQESRASDWHSKTKDFQESSIKSLKEKLLLEEEPTTSHGQSSQGIVEETSEEGNSVPASQ<br>SVAALTSKRSLVLMPESSAEEITVCPETQLSSSETFDLEREVSPGSRDILDGVRIIMADK<br>EVGNKEDAEKEVAISTFSSSNQVSCPLCDQCFPPTKIERHAMYCNGLMEEDTVLIRRQKE<br>AKTKSDSGTAAQTSLDIDKNEKCYLCKSLVPFREYQCHVDSCLQLAKADQGDGPEGSGRA<br>CSTVEGKWQQRLKNPKEKGHSEGRLLSFLEQSEHKTSDADIKSSETGAFRVPSPGMEEAG<br>CSREMQSSFTRRDLNESPVKSFVSISEATDCLVDFKKQVTVQPGSRTRTKAGRGRRRKF<br>>sp\|Q96RL1-2\|UIMC1_HUMAN Isoform 2 of BRCA1-<br>A complex subunit RAP80 OS = Homo sapiens GN = UIMC1<br>MPRRKKKVKEVSESRNLEKKDVETTSSVSVKRKRRLEDAFIVISDSDGEEPKEENGLQKT<br>KTKQSNRAKCLAKRKIAQMTEEEQFALALKMSEQEAREVNSQEEEEEELLRKAIAESLNS<br>CRPSDASATRSRPLATGPSSQHQEKTTDSGLTEGIWQLVPPSLFKGSHISQGNEAEERE<br>EPWDHTEKTEEEPVSGSSGSWDQSSQPVFENVNVKSFDRCTGHSAEHTQCGKPQSSQGIV<br>EETSEEGNSVPASQSVAALTSKRSLVLMPESSAEEITVCPETQLSSSETFDLEREVSPGS<br>RDILDGVRIIMADKEVGNKEDAEKEVAISTFSSSNQVSCPLCDQCFPPTKIERHAMYCNG<br>LMEEDTVLTRRQKEAKTKSDSGTAAQTSLDIDKNEKCYLCKSLVPFREYQCHVDSCLQLA<br>KADQGDGPEGSGRACSTVEGKWQQRLKNPKEKGHSEGRLLSFLEQSEHKTSDADIKSSET<br>GAFRVPSPGMEEAGCSREMQSSFTRRDLNESPVKSFVSISEATDCLVDFKKQVTVQPGSR<br>TRTKAGRGRRRKF<br>>sp\|Q96RL1-3\|UIMC1_HUMAN Isoform 3 of BRCA1-<br>A complex subunit RAP80 OS = Homo sapiens GN = UIMC1<br>MTEEEQFALALKMSEQEAREVNSQEEEEEELLRKAIAESLNSCRPSDASATRSRPLATGP<br>SSQSHQEKTTDSGLTEGIWQLVPPSLFKGSHISQGNEAEEREEPWDHTEKTEEEPVSGSS<br>GSWDQSSQPVFENVNVKSFDRCTGHSAEHTQCGKPQESTGRGSAFLKAVQGSGDTSRHCL<br>PTLADAKGLQDTGGIVNYFWGIPFCPDGVDPNQYTKVILCQLEVYQKSLKMAQRQLLNKK<br>GFGEPVLPRPPSLIQNECGQGEQASEKNECISEDMGDEDKEERQESRASDWHSKTKDFQE<br>SSIKSLKEKLLLEEEPTTSHGQSSQGIVEETSEEGNSVPASQSVAALTSKRSLVLMPESS<br>AEEITVCPETQLSSSETFDLEREVSPGSRDILDGVRIIMADKEVGNKEDAEKEVAISTFS<br>SSNQVSCPLCDQCFPPTKIERHAMYCNGLMEEDTVLIRRQKEAKIKSDSGTAAQTSLDID<br>KNEKCYLCKSLVPFREYQCHVDSCLQLAKADQGDGPEGSGRACSTVEGKWQQRLKNPKEK<br>GHSEGRLLSFLEQSEHKTSDADIKSSETGAFRVPSPGMEEAGCSREMQSSFTRRDLNESP<br>VKSFVSISEATDCLVDFKKQVTVQPGSRTRTKAGRGRRRKF<br>>sp\|Q96RL1-4\|UIMC1_HUMAN Isoform 4 of BRCA1-<br>A complex subunit RAP80 OS = Homo sapiens GN = UIMC1<br>MLPLPDLDLWPLDRLPSPIKRKPQTLGSLKSSQGIVEETSEEGNSVPASQSVAALTSKRS<br>LVLMPESSAEEITVCPETQLSSSETFDLEREVSPGSRDILDGVRIIMADKEVGNKEDAEK<br>EVAISTFSSSNQVSCPLCDQCFPPTKIERHAMYCNGLMEEDTVLTRRQKEAKTKSDSGTA<br>AQTSLDIDKNEKCYLCKSLVPFREYQCHVDSCLQLAKADQGDGPEGSGRACSTVEGKWQQ<br>RLKNPKEKGHSEGRLLSFLEQSEHKTSDADIKSSETGAFRVPSPGMEEAGCSREMQSSFT<br>RRDLNESPVKSFVSISEATDCLVDFKKQVTVQPGSRTRTKAGRGRRRKF<br>>sp\|Q96RL1-5\|UIMC1_HUMAN Isoform 5 of BRCA1-<br>A complex subunit RAP80 OS = Homo sapiens GN = UIMC1<br>MPRRKKKVKEVSESRNLEKKDVETTSSVSVKRKRRLEDAFIVISDSDGEEPKEENGLQKT |

TABLE VI.4-continued

Factors that promote anti-HR.

| Factor | Sequence |
|---|---|
|  | KTKQSNRAKCLAKRKIAQMTEEEQFALALKMSEQEAREVNSQEEEEEELLRKAIAESLNV<br>NMPCCKSLWRLISYIFDFCGVVVALGTSCSHL |
| miR-155 | See Table VI.5 |
| miR-545 | See Table VI.5 |
| miR-107 | See Table VI.5 |
| miR-1255 | See Table VI.5 |
| miR-148 | See Table VI.5 |
| miR-193 | See Table VI.5 |

More specifically, in some embodiments, the down-regulator of an anti-HR pathway is an inhibitor of (e.g., an siRNA against) anti-HR helicase, FBH1, RECQ5, BLM, a RecQ helicase, PARI, Rap80, FANCJ, FANCM, RECQ1, or RAD54, or an anti-miR that targets miR-155, miR-545, miR-107, miR-1255, miR-148, or miR-193, or an agent of Table VI.5, or any combination thereof. In some embodiments, an anti-HR pathway is down regulated using an HDR-enhancing gRNA that targets a component of an anti-HR pathway, e.g., anti-HR helicase, FBH1, RECQ5, BLM, a RecQ helicase, PARI, Rap80, FANCJ, FANCM, RECQ1, or RAD54. In some embodiments, the HDR-enhancing gRNA is used in combination with an eiCas9 molecule. In some embodiments, the HDR-enhancing gRNA is used in combination with an eaCas9 molecule. In some embodiments, the HDR-enhancing gRNA is administered to the cell as a HDR-enhancing gRNA:Cas9 molecule complex.

TABLE VI.5

Down-regulators of the anti-HR pathway.

1. Fbh1

| | |
|---|---|
| siRNA | FBXO18 Silencer, sold by Life Technologies<br>FBXO18 F-box protein, helicase, 18 siRNA, sold by<br>Dharmacon Commercially available from Dharmacon<br>or Ambion |
| antibodies | Mouse Anti-Fbh1 antibody, monoclonal (2353C1a),<br>sold by Lifespan Biosciences<br>Anti-FBXO18/FBH1 antibody (aa748-777) LS-C166079,<br>sold by Lifespan Biosciences |

2. RTEL

| | |
|---|---|
| siRNA | Commercially available from Dharmacon or Ambion |

3. PARPI

| | |
|---|---|
| siRNA | PMCH Silencer, sold by Life Technologies;<br>PARPBP PARP1 binding protein siRNA, sold by Dharmacon;<br>Commercially available from Dharmacon or Ambion |
| antibodies | PARP1 Binding Protein (PARPBP) (C-Term), (AA 522-550)<br>antibody, sold by Aviva Systems Biology;<br>PARP1 Binding Protein (PARPBP) (C-Term), (AA 522-550)<br>antibody, sold by Atlas Antibodies |

4. Rap80

| | | | | | |
|---|---|---|---|---|---|
| siRNA | UIMC1 Silencer, sold by Life Technologies;<br>RAP80 siRNA (h), sold by Santa Cruz Biotechnology | | | | |
| | Entrez<br>Gene<br>Symbol | Entrez<br>Gene<br>ID | GenBank<br>Acc. No. | Reagent<br>Source ID | Sequence (sense) |
| | Rap 80 | 51720 | NM_016290 | D-006995-01 | GAAAAUGGGUUGCAGAAAA |
| | Rap 80 | 51720 | NM_016290 | D-006995-03 | AGAGGCAGCUCCUUAAUAA |
| | Rap 80 | 51720 | NM_016290 | D-006995-04 | GCACAAGACUUCAGAUGCA |
| | Rap 80 | 51720 | NM_016290 | D-006995-05 | GGACACAUCUAGGCACUGU |
| antibodies | RAP80 Antibody, sold by Bethyl Laboratories;<br>Anti-RAP80 antibody (EPR5315) (ab124763), sold by Abcam; | | | | |

TABLE VI.5-continued

Down-regulators of the anti-HR pathway.

RAP80 (C-13) antibody, sold by Santa Cruz Biotechnology;
RAP80 (E-17) antibody, sold by Santa Cruz Biotechnology;
RAP80 (H-260) antibody, sold by Santa Cruz Biotechnology 5. Anti-miR for:

| mature miRNA | | Anti-miR sequence |
|---|---|---|
| miR-155-5p | UUAAUGCUAAUCGUGAUAGGGGU | ACCCCUAUCACGAUUAGCAUUAA |
| miR-155-3p | CUCCUACAUAUUAGCAUUAACA | UGUUAAUGCUAAUAUGUAGGAG |
| miR-545-5p | UCAGUAAAUGUUUAUUAGAUGA | UCAUCUAAUAAACAUUUACUGA |
| miR-545-3p | UCAGCAAACAUUUAUUGUGUGC | GCACACAAUAAAUGUUUGCUGA |
| miR-107 | AGCAGCAUUGUACAGGGCUAUCA | UGAUAGCCCUGUACAAUGCUGCU |
| miR-1255-A | AGGAUGAGCAAAGAAAGUAGAUU | AAUCUACUUUCUUUGCUCAUCCU |
| miR-1255-B1 | CGGAUGAGCAAAGAAAGUGGUU | AACCACUUUCUUUGCUCAUCCG |
| miR-1255-B2 | CGGAUGAGCAAAGAAAGUGGUUU | AACCACUUUCUUUGCUCAUCCG |
| miR-148-5p | AAAGUUCUGAGACACUCCGACU | AGUCGGAGUGUCUCAGAACUUU |
| miR-148-3p | UCAGUGCACUACAGAACUUUGU | ACAAAGUUCUGUAGUGCACUGA |
| miR-193-5p | UGGGUCUUUGCGGGCGAGAUGA | UCAUCUCGCCCGCAAAGACCCA |
| miR-193-3p | AACUGGCCUACAAAGUCCCAGU | ACUGGGACUUUGUAGGCCAGUU |

In other embodiments, the down-regulator of an HR pathway is an agent that promotes HDR by inhibiting resection. In one embodiment, agents that promotes HDR by inhibiting resection are listed in Table VI.6.

VI.3 Canonical Non-Homologous End-Joining (Canonical NHEJ)

Canonical non-homologous end-joining is a second repair pathway that operates on double-stranded breaks. In contrast

TABLE VI.6

Anti-HR Agents that Promote HDR by Inhibiting Resection

1) CtIP

| | Entrez Gene Symbol | Entrez Gene ID | GenBank Acc. No. | Reagent Source ID | Sequence (sense) |
|---|---|---|---|---|---|
| siRNA | CtIP | 5932 | NM_002894 | D-011376-01 | GAGCAGACCUUUCUCAGUA |
| | CtIP | 5932 | NM_002894 | D-011376-02 | GAAGUGAACAAGAUCAUUA |
| | CtIP | 5932 | NM_002894 | D-011376-03 | CAACCAAGAUGUAUCCUUU |
| | CtIP | 5932 | NM_002894 | D-011376-04 | GAAUAGGACUGAGUACGGU |
| | CtIP | 5932 | NM_203292 | J-011376-05 | GGAGCUACCUCUAGUAUCA |
| | CtIP | 5932 | NM_203292 | J-011376-06 | GAGGUUAUAUUAAGGAAGA |
| | CtIP | 5932 | NM_203292 | J-011376-07 | GAACAGAAUAGGACUGAGU |
| | CtIP | 5932 | NM_203292 | J-011376-08 | GCACGUUGCCCAAAGAUUC |
| | CtIP | 5932 | NM_002894 | s11849 | UUACUUGUAAACCUUGUACtt |
| | CtIP | 5932 | NM_002894 | s11850 | AAAUCGAUCAGACAGAUCCag |
| | CtIP | 5932 | NM_002894 | s11851 | UCUUGUUCACUUCAGACCCaa |

2) Exo1

| siRNA | Commercially available from Dharmacon or Ambion |
|---|---|

3) DNA2

| siRNA | Commercially available from Dharmacon or Ambion |
|---|---|

4) MRN complex

| Compounds | Phase |
|---|---|
| Mirin | Phase I/II |
| Telomelysin | |
| Resveratrol | | to HDR, canonical NHEJ typically acts when a DSB has blunt, unresected ends that are ligation-competent. The canonical NHEJ pathway can involve end processing i.e., deletions and/or fresh synthesis i.e., insertions. It can yield three types of different outcomes: correct repair (error free repair) or approximately 1 to 4 nucleotide insertions or deletions.

Canonical NHEJ depends on KU70-80 and Xrcc4/Ligase IV. Briefly, the core components of this pathway are KU70-80, DNApk, Artemis nuclease, DNA Polymerase, and ligase IV-XRCC4-XLF (these last 3 work as a complex to ligate ends). The pathway components are discussed below in more detail.

After a DSB forms, the toroidal heterodimer Ku70/Ku80 loads and then activates DNA-PKcs. DNA-PKcs stabilizes the DNA ends, preventing resection, and thus promotes canonical NHEJ over HDR and other DSB repair pathways. 53BP1 may also increase the stability of DSBs, thereby promoting canonical NHEJ. RIF1 and PTIP assist 53BP1 in this function. 53BP1 may also increase DSB mobility, allowing the DNA ends to find each other as is required for ligation. 53BP1, Rif1, and PTIP are not members of the core canonical NHEJ pathway. Rather, they act upstream of it, and regulate whether the core canonical NHEJ machinery engages at all. 53BP1, Rif1, and PTIP are anti-resection proteins.

To catalyze repair, XRCC4/LIG4 is recruited. If both ends are blunt and ligatable, a trimer of XRCC4, and LIG4 and XLF (a stimulatory factor) ligate the ends together. If ligation is not possible, an end-processing enzyme such as ARTEMIS or an APLF nuclease or the PNK kinase/phosphatase can transform the break into a substrate for ligation. Artemis, also known as DCLRE1C (DNA cross-link repair 1C), has endonuclease activity on 5' and 3' overhangs, and a 5' to 3' exonuclease activity.

In some embodiments, HDR can be promoted by down-regulating a canonical NHEJ pathway. In some embodiments, a Cas9 molecule and gRNA can induce a DSB in a desired location during G1 or another phase of the cycle. This DSB can be formed using, e.g., one Cas9 molecule with the ability to produce DSBs, or two nickases. A canonical NHEJ down-regulator prevents repair of a DSB in G1. While in some cases that break might be repaired by, e.g., MMEJ, in other cases it will persist until S/G2, when HDR becomes active. A template nucleic acid can be added to the cell, so that the HDR machinery repairs the DSB using the template nucleic acid.

Accordingly, in some embodiments, the methods described herein involve down-regulating a canonical NHEJ pathway in order to promote HDR. For instance, the methods may involve modulating, e.g., inhibiting, a component (e.g., exactly one component, or one or more components, e.g., two or three components) of the canonical NHEJ pathway, e.g., a component of Table VI.7, VI.1(A), or VI.1(B). More specifically, in some embodiments, the methods described herein may involve modulating, e.g., inhibiting, exactly one of, or one or more of a Ku protein, Ku70, Ku80, DNA Pk, DNA-PKcs, 53BP1, XRCC4, LIG4, XLF, ARTEMIS, an APLF, or PNK. In some embodiments, the methods described herein may involve inhibiting an anti-resection protein, e.g., one or more of 53BP1, Rift, and PTIP, in order to promote repair by HDR rather than canonical NHEJ. Up-regulation of HDR, in some embodiments, is achieved using siRNA directed against one or more of a Ku protein, Ku70, Ku80, DNA Pk, DNA-PKcs, 53BP1, XRCC4, LIG4, XLF, ARTEMIS, an APLF, PNK, Rift, or PTIP. In some embodiments, a canonical NHEJ pathway is down regulated using an HDR-enhancing gRNA that targets a component of a canonical NHEJ pathway, e.g., one or more of a Ku protein, Ku70, Ku80, DNA Pk, DNA-PKcs, 53BP1, XRCC4, LIG4, XLF, ARTEMIS, an APLF, PNK, Rift, or PTIP. In some embodiments, the HDR-enhancing gRNA is used in combination with an eiCas9 molecule. In some embodiments, the HDR-enhancing gRNA is used in combination with an eaCas9 molecule. In some embodiments, the HDR-enhancing gRNA is administered to the cell as a HDR-enhancing gRNA:Cas9 molecule complex. In another embodiment, the up-regulator of HDR is a dominant negative CtIP. A dominant negative CtIP promotes resection in G1 phase.

In some embodiments, one or more of HDR, alt-HR, anti-HR, MMEJ, SSA, SSBR, MMR, NER, and BER are not substantially down-regulated, e.g., the only DNA damage repair pathway to be substantially down-regulated is the canonical NHEJ pathway.

TABLE VI.7

Factors that promote canonical NHEJ

| Factor | Sequence |
|---|---|
| a Ku protein | — |
| Ku70 (also called XRCC6) | >sp\|P12956\|XRCC6_HUMAN X-ray repair cross-complementing protein 6 OS = Homo sapiens GN = XRCC6 PE = 1 SV = 2<br>MSGWESYYKTEGDEEAEEEQEENLEASGDYKYSGRDSLIFLVDASKAMFESQSEDELTPF<br>DMSIQCIQSVYISKIISSDRDLLAVVFYGTEKDKNSVNFKNIYVLQELDNPGAKRILELD<br>QFKGQQGQKRFQDMMGHGSDYSLSEVLWVCANLFSDVQFKMSHKRIMLFTNEDNPHGNDS<br>AKASRARTKAGDLRDTGIFLDLMHLKKPGGFDISLFYRDIISIAEDEDLRVHFEESSKLE<br>DLLRKVRAKETRKRALSRLKLKLNKDIVISVGIYNLVQKALKPPPIKLYRETNEPVKTKT<br>RTFNTSTGGLLLPSDTKRSQIYGSRQIILEKEETEELKRFDDPGLMLMGFKPLVLLKKHH<br>YLRPSLFVYPEESLVIGSSTLFSALLIKCLEKEVAALCRYTPRRNIPPYFVALVPQEEEL<br>DDQKIQVTPPGFQLVFLPFADDKRKMPFTEKIMATPEQVGKMKAIVEKLRFTYRSDSFEN<br>PVLQQHFRNLEALALDLMEPEQAVDLTLPKVEAMNKRLGSLVDEFKELVYPPDYNPEGKV<br>TKRKHDNEGSGSKRPKVEYSEEELKTHISKGTLGKFTVPMLKEACRAYGLKSGLKKQELL<br>EALTKHFQD<br>>sp\|P12956-2\|XRCC6_HUMAN Isoform 2 of X-ray repair cross-complementing protein 6 OS = Homo sapiens GN = XRCC6<br>MSGWESYYKTEGDEEAEEEQEENLEASGDYKYSGRDSLIFLVDASKAMFESQSEDELTPF<br>DMSIQELDNPGAKRILELDQFKGQQGQKRFQDMMGHGSDYSLSEVLWVCANLFSDVQFKM<br>SHKRIMLFTNEDNPHGNDSAKASRARTKAGDLRDTGIFLDLMHLKPGGFDISLFYRDII<br>SIAEDEDLRVHFEESSKLEDLLRKVRAKETRKRALSRLKLKLNKDIVISVGIYNLVQKAL<br>KPPPIKLYRETNEPVKIKTRIFNISIGGLLLPSDTKRSQIYGSRQIILEKEETEELKRFD<br>DPGLMLMGFKPLVLLKKHHYLRPSLFVYPEESLVIGSSTLFSALLIKCLEKEVAALCRYT |

TABLE VI.7-continued

Factors that promote canonical NHEJ

| Factor | Sequence |
|---|---|
| | PRRNIPPYFVALVPQEEELDDQKIQVIPPGFQLVFLPFADDKRKMPFTEKIMATPEQVGK<br>MKAIVEKLRFTYRSDSFENPVLQQHFRNLEALALDLMEPEQAVDLTLPKVEAMNKRLGSL<br>VDEFKELVYPPDYNPEGKVIKRKHDNEGSGSKRPKVEYSEEELKTHISKGILGKFTVPML<br>KEACRAYGLKSGLKKQELLEALTKHFQD |
| Ku80 | >sp\|P13010\|XRCC5_HUMAN X-ray repair cross-complementing protein 5<br>OS = Homo sapiens GN = XRCC5 PE = 1 SV = 3<br>MVRSGNKAAVVLCMDVGFTMSNSIPGIESPFEQAKKVITMFVQRQVFAENKDEIALVLFG<br>IDGIDNPLSGGDQYQNITVHRHLMLPDFDLLEDIESKIQPGSQQADFLDALIVSMDVIQH<br>ETIGKKFEKRHIEIFIDLSSRFSKSQLDIIIHSLKKCDISLQFFLPFSLGKEDGSGDRGD<br>GPFRLGGHGPSFPLKGITEQQKEGLEIVKMVMISLEGEDGLDEIYSFSESLRKLCVFKKI<br>ERHSIHWPCRLTIGSNLSIRIAAYKSILQERVKKTWTVVDAKTLKKEDIQKETVYCLNDD<br>DETEVLKEDIIQGFRYGSDIVPFSKVDEEQMKYKSEGKCFSVLGFCKSSQVQRRFFMGNQ<br>VLKVFAARDDEAAAVALSSLIHALDDLDMVAIVRYAYDKRANPQVGVAPFHIKHNYECLV<br>YVQLPFMEDLRQYMFSSLKNSKKYAPTEAQLNAVDALIDSMSLAKKDEKTDTLEDLFPTT<br>KIPNPRFQRLFQCLLHRALHPREPLPPIQQHIWNMLNPPAEVTTKSQIPLSKIKTLFPLI<br>EAKKKDQVTAQEIFQDNHEDGPTAKKLKTEQGGAHFSVSSLAEGSVTSVGSVNPAENFRV<br>LVKQKKASFEEASNQLINHIEQFLDTNETPYFMKSIDCIRAFREEAIKFSEEQRFNNFLK<br>ALQEKVEIKQLNHFWEIVVQDGITLITKEEASGSSVTAEEAKKFLAPKDKPSGDTAAVFE<br>EGGDVDDLLDMI |
| DNA Pk | — |
| DNA-PKcs | >sp\|P78527\|PRKDC_HUMAN DNA-dependent protein kinase catalytic<br>subunit OS = Homo sapiens GN = PRKDC PE = 1 SV = 3<br>MAGSGAGVRCSLLRLQETLSAADRCGAALAGHQLIRGLGQECVLSSSPAVLALQTSLVFS<br>RDFGLLVFVRKSLNSIEFRECREEILKFLCIFLEKMGQKIAPYSVEIKNTCTSVYTKDRA<br>AKCKIPALDLLIKLLQTFRSSRLMDEFKIGELFSKFYGELALKKKIPDTVLEKVYELLGL<br>LGEVHPSEMINNAENLFRAFLGELKTQMTSAVREPKLPVLAGCLKGLSSLLCNFTKSMEE<br>DPQTSREIFNFVLKAIRPQIDLKRYAVPSAGLRLFALHASQFSTCLLDNYVSLFEVLLKW<br>CAHTNVELKKAALSALESFLKQVSNMVAKNAEMHKNKLQYFMEQFYGIIRNVDSNNKELS<br>IAIRGYGLFAGPCKVINAKDVDFMYVELIQRCKQMFLTQTDTGDDRVYQMPSFLQSVASV<br>LLYLDTVPEVYTPVLEHLVVMQIDSFPQYSPKMQLVCCRAIVKVFLALAAKGPVLRNCIS<br>TVVHQGLIRICSKPVVLPKGPESESEDHRASGEVRTGKWKVPTYKDYVDLFRHLLSSDQM<br>MDSILADEAFFSVNSSSESLNHLLYDEFVKSVLKIVEKLDLTLEIQTVGEQENGDEAPGV<br>WMIPTSDPAANLHPAKPKDFSAFINLVEFCREILPEKQAEFFEPWVYSFSYELILQSTRL<br>PLISGFYKLLSITVRNAKKIKYFEGVSPKSLKHSPEDPEKYSCFALFVKFGKEVAVKMKQ<br>YKDELLASCLTFLLSLPHNIIELDVRAYVPALQMAFKLGLSYTPLAEVGLNALEEWSIYI<br>DRHVMQPYYKDILPCLDGYLKTSALSDETKNNWEVSALSRAAQKGFNKVVLKHLKKTKNL<br>SSNEAISLEEIRIRVVQMLGSLGGQINKNLLTVTSSDEMMKSYVAWDREKRLSFAVPFRE<br>MKPVIFLDVFLPRVTELALTASDRQTKVAACELLHSMVMFMLGKATQMPEGGQGAPPMYQ<br>LYKRTFPVLLRLACDVDQVTRQLYEPLVMQLIHWFTNNKKFESQDTVALLEAILDGIVDP<br>VDSTLRDFCGRCIREFLKWSIKQITPQQQEKSPVNTKSLFKRLYSLALHPNAFKRLGASL<br>AFNNIYREFREEESLVEQFVFEALVIYMESLALAHADEKSLGTIQQCCDAIDHLCRIIEK<br>KHVSLNKAKKRRLPRGFPPSASLCLLDLVKWLLAHCGRPQTECRHKSIELFYKFVPLLPG<br>NRSPNLWLKDVLKEEGVSFLINTFEGGGCGQPSGILAQPTLLYLRGPFSLQATLCWLDLL<br>LAALECYNTFIGERTVGALQVLGTEAQSSLLKAVAFFLESIAMHDIIAAEKCFGTGAAGN<br>RTSPQEGERYNYSKCTVVVRIMEFTTTLLNTSPEGWKLLKKDLCNTHLMRVLVQTLCEPA<br>SIGFNIGDVQVMAHLPDVCVNLMKALKMSPYKDILETHLREKITAQSIEELCAVNLYGPD<br>AQVDRSRLAAVVSACKQLHRAGLLHNILPSQSTDLHHSVGTELLSLVYKGIAPGDERQCL<br>PSLDLSCKQLASGLLELAFAFGGLCERLVSLLLNPAVLSTASLGSSQGSVIHFSHGEYFY<br>SLFSETINTELLKNLDLAVLELMQSSVDNTKMVSAVLNGMLDQSFRERANQKHQGLKLAT<br>TILQHWKKCDSWWAKDSPLETKMAVLALLAKILQIDSSVSFNTSHGSFPEVFTTYISLLA<br>DTKLDLHLKGQAVTLLPFFTSLTGGSLEELRRVLEQLIVAHPMQSREFPPGTPRFNNYV<br>DCMKKFLDALELSQSPMLLELMTEVLCREQQHVMEELFQSSFRRIARRGSCVTQVGLLES<br>VYEMFRKDDPRLSFTRQSFVDRSLLTLLWHCSLDALREFFSTIVVDAIDVLKSRFTKLNE<br>STFDTQITKKMGYYKILDVMYSRLPKDDVHAKESKINQVFHGSCITEGNELTKTLIKLCY<br>DAFTENMAGENQLLERRRLYHCAAYNCAISVICCVFNELKFYQGFLFSEKPEKNLLIFEN<br>LIDLKRRYNFPVEVEVPMERKKKYIEIRKEAREAANGDSDGPSYMSSLSYLADSTLSEEM<br>SQFDFSTGVQSYSYSSQDPRPATGRFRRREQRDPTVHDDVLELEMDELNRHECMAPLTAL<br>VKHMHRSLGPPQGEEDSVPRDLPSWMKFLHGKLGNPIVPLNIRLFLAKLVINTEEVFRPY<br>AKHWLSPLLQLAASENNGGEGIHYMVVEIVATILSWTGLATPTGVPKDEVLANRLLNFLM<br>KHVFHPKRAVFRHNLEIIKTLVECWKDCLSIPYRLIFEKFSGKDPNSKDNSVGIQLLGIV<br>MANDLPPYDPQCGIQSSEYFQALVNNMSFVRYKEVYAAAAEVLGLILRYVMERKNILEES<br>LCELVAKQLKQHQNTMEDKFIVCLNKVTKSFPPLADRFMNAVFFLLPKFHGVLKTLCLEV<br>VLCRVEGMTELYFQLKSKDFVQVMRHRDDERQKVCLDIIYKMMPKLKPVELRELLNPVVE<br>FVSHPSTTCREQMYNILMWIHDNYRDPESETDNDSQEIFKLAKDVLIQGLIDENPGLQLI<br>IRNFWSHETRLPSNTLDRLLALNSLYSPKIEVHFLSLATNFLLEMTSMSPDYPNPMFEHP<br>LSECEFQEYTIDSDWRFRSTVLTPMFVETQASQGTLQTRTQEGSLSARWPVAGQIRATQQ<br>QHDFTLTQTADGRSSFDWLTGSSTDPLVDHTSPSSDSLLFAHKRSERLQRAPLKSVGPDF<br>GKKRLGLPGDEVDNKVKGAAGRTDLLRLRRRPMRDQEKSLLSMYARKGVAEQKREKEIKSE<br>LKMKQDAQVVLYRSYRHGDLPDIQIKHSSLITPLQAVAQRDPIIAKQLFSSLFSGILKEM<br>DKFKTLSEKNNITQKLLQDFNRFLNTTFSFPPFVSCIQDISCQHAALLSLDPAAVSAGC<br>LASLQQPVGIRLLEEALLRLLPAELPAKRVRGKARLPPDVLRWVELAKLYRSIGEYDVLR<br>GIFTSEIGTKQITQSALLAEARSDYSEAAKQYDEALNKQDWVDGEPTEAEKDFWELASLD<br>CYNHLAEWKSLEYCSTASIDSENPPDLNKIWSEPFYQETYLPYMIRSKLKLLLQGEADQS |

TABLE VI.7-continued

Factors that promote canonical NHEJ

| Factor | Sequence |
|---|---|
| | LLTFIDKAMHGELQKAILELHYSQELSLLYLLQDDVDRAKYYIQNGIQSFMQNYSSIDVL<br>LHQSRLTKLQSVQALTEIQEFISFISKQGNLSSQVPLKRLLNTWTNRYPDAKMDPMNIWD<br>DIITNRCFFLSKIEEKLTPLPEDNSMNVDQDGDPSDRMEVQEQEEDISSLIRSCKFSMKM<br>KMIDSARKQNNFSLAMKLLKELHKESKTRDDWLVSWVQSYCRLSHCRSRSQGCSEQVLTV<br>LKTVSLLDENNVSSYLSKNILAFRDQNILLGTTYRIIANALSSEPACLAEIEEDKARRIL<br>ELSGSSSEDSEKVIAGLYQRAFQHLSEAVQAAEEEAQPPSWSCGPAAGVIDAYMTLADFC<br>DQQLRKEEENASVIDSAELQAYPALVVEKMLKALKLNSNEARLKFPRLLQIIERYPEETL<br>SLMTKEISSVPCWQFISWISHMVALLDKDQAVAVQHSVEEITDNYPQAIVYPFIISSESY<br>SFKDTSTGHKNKEFVARIKSKLDQGGVIQDFINALDQLSNPELLFKDWSNDVRAELAKTP<br>VNKKNIEKMYERMYAALGDPKAPGLGAFRRKFIQTFGKEFDKHFGKGGSKLLRMKLSDFN<br>DITNMLLLKMNKDSKPPGNLKECSPWMSDFKVEFLRNELEIPGQYDGRGKPLPEYHVRIA<br>GFDERVTVMASLRRPKRIIIRGHDEREHPFLVKGGEDLRQDQRVEQLFQVMNGILAQDSA<br>CSQRALQLRTYSVVPMTSRLGLIEWLENTVTLKDLLLNTMSQEEKAAYLSDPRAPPCEYK<br>DWLTKMSGKHDVGAYMLMYKGANRTETVTSFRKRESKVPADLLKRAFVRMSTSPEAFLAL<br>RSHFASSHALICISHWILGIGDRHLNNFMVAMETGGVIGIDFGHAFGSATQFLPVPELMP<br>FRLTRQFINLMLPMKETGLMYSIMVHALRAFRSDPGLLTNTMDVFVKEPSFDWKNFEQKM<br>LKKGGSWIQEINVAEKNWYPRQKICYAKRKLAGANPAVITCDELLLGHEKAPAFRDYVAV<br>ARGSKDHNIRAQEPESGLSEETQVKCLMDQATDPNILGRTWEGWEPWM |
| | >sp\|P78527-2\|PRKDC_HUMAN Isoform 2 of DNA-dependent protein kinase catalytic subunit OS = *Homo sapiens* GN = PRKDC<br>MAGSGAGVRCSLLRLQETLSAADRCGAALAGHQLIRGLGQECVLSSSPAVLALQTSLVFS<br>RDFGLLVFVRKSLNSIEFRECREEILKFLCIFLEKMGQKIAPYSVEIKNTCTSVYTKDRA<br>AKCKIPALDLLIKLLQTFRSSRLMDEFKIGELFSKFYGELALKKKIPDTVLEKVYELLGL<br>LGEVHPSEMINNAENLFRAFLGELKTQMTSAVREPKLPVLAGCLKGLSSLLCNFTKSMEE<br>DPQTSREIFNFVLKAIRPQIDLKRYAVPSAGLRLFALHASQPFSTCLLDNYVSLFEVLLKW<br>CAHTNVELKKAALSALESFLKQVSNMVAKNAEMHKNKLQYFMEQFYGIIRNVDSNNKELS<br>IAIRGYGLFAGPCKVINAKDVDFMYVELIQRCKQMFLTQTDTGDDRVYQMPSFLQSVASV<br>LLYLDTVPEVYTPVLEHLVVMQIDSFPQYSPKMQLVCCRAIVKVFLALAAKGPVLRNCIS<br>TVVHQGLIRICSKPVVLPKGPESESEDHRASGEVRTGKWKVPTYKDYVDLFRHLLSSDQM<br>MDSILADEAFFSVNSSSESLNHLLYDEFVKSVLKIVEKLDLTLEIQTVGEQENGDEAPGV<br>WMIPTSDPAANLHPAKPKDFSAFINLVEFCREILPEKQAEFFEPWVYSFSYELILQSTRL<br>PLISGFYKLLSITVRNAKKIKYFEGVSPKSLKHSPEDPEKYSCFALFVKFGKEVAVKMKQ<br>YKDELLASCLTFLLSLPHNIIELDVRAYVPALQMAFKLGLSYTPLAEVGLNALEEWSIYI<br>DRHVMQPYYKDILPCLDGYLKTSALSDETKNNWEVSALSRAAQKGFNKVVLKHLKKTKNL<br>SSNEAISLEEIRIRVVQMLGSLGGQINKNLLTVTSSDEMMKSYVAWDREKRLSFAVPFRE<br>MKPVIFLDVFLPRVTELALTASDRQTKVAACELLHSMVMFMLGKATQMPEGGQGAPPMYQ<br>LYKRTFPVLLRLACDVDQVTRQLYEPLVMQLIHWFTNNKKFESQDTVALLEAILDGIVDP<br>VDSTLRDFCGRCIREFLKWSIKQITPQQQEKSPVNTKSLFKRLYSLALHPNAFKRLGASL<br>AFNNIYREFREEESLVEQFVFEALVIYMESLALAHADEKSLGTIQQCCDAIDHLCRIIEK<br>KHVSLNKAKKRRLPRGFPPSASLCLLDLVKWLLAHCGRPQTECRHKSIELFYKFVPLLPG<br>NRSPNLWLKDVLKEEGVSFLINTFEGGGCGQPSGILAQPTLLYLRGPFSLQATLCWLDLL<br>LAALECYNTFIGERTVGALQVLGTEAQSSLLKAVAFFLESIAMHDIIAAEKCFGTGAAGN<br>RTSPQEGERYNYSKCTVVVRIMEFTTTLLNTSPEGWKLLKKDLCNTHLMRVLVQTLCEPA<br>SIGFNIGDVQVMAHLPDVCVNLMKALKMSPYKDILETHLREKITAQSIEELCAVNLYGPD<br>AQVDRSRLAAVVSACKQLHRAGLLHNILPSQSTDLHHSVGTELLSLVYKGIAPGDERQCL<br>PSLDLSCKQLASGLLELAFAFGGLCERLVSLLLNPAVLSTASLGSSQGSVIHFSHGEYFY<br>SLFSETINTELLKNLDLAVLELMQSSVDNTKMVSAVLNGMLDQSFRERANQKHQGLKLAT<br>TILQHWKKCDSWWAKDSPLETKMAVLALLAKILQIDSSVSFNTSHGSFPEVFTTYISLLA<br>DTKLDLHLKGQAVTLLPFFTSLTGGSLEELRRVLEQLIVAHFPMQSREFPPGTPRFNNYV<br>DCMKKFLDALELSQSPMLLELMTEVLCREQQHVMEELFQSSFRRIARRGSCVTQVGLLES<br>VYEMFRKDDPRLSFTRQSFVDRSLLTLLWHCSLDALREFFSTIVVDAIDVLKSRFTKLNE<br>STFDTQITKKMGYYKILDVMYSRLPKDDVHAKESKINQVFHGSCITEGNELTKTLIKLCY<br>DAFTENMAGENQLLERRRLYHCAAYNCAISVICCVFNELKFYQGFLFSEKPEKNLLIFEN<br>LIDLKRRYNFPVEVEVPMERKKKYIEIRKEAREAANGDSDGPSYMSSLSYLADSTLSEEM<br>SQFDFSTGVQSYSYSSQDPRPATGRFRRREQRDPTVHDDVLELEMDELNRHECMAPLTAL<br>VKHMRSLGPPQGEEDSVPRDLPSWMKFLHGKLGNPIVPLNIRLFLAKLVINTEEVFRPY<br>AKHWLSPLLQLAASENNGGEGIHYMVVEIVATILSWTGLATPTGVPKDEVLANRLLNFLM<br>KHVFHPKRAVFRHNLEIIKTLVECWKDCLSIPYRLIFEKFSGKDPNSKDNSVGIQLLGIV<br>MANDLPPYDPQCGIQSSEYFQALVNNMSFVRYKEVYAAAAEVLGLILRYVMERKNILEES<br>LCELVAKQLKQHQNTMEDKFIVCLNKVTKSFPPLADRFMNAVFFLLPKFHGVLKTLCLEV<br>VLCRVEGMTELYFQLKSKDFVQVMRHRDDERQKVCLDIIYKMMPKLKPVELRELLNPVVE<br>FVSHPSTTCREQMYNILMWIHDNYRDPESETDNDSQEIFKLAKDVLIQGLIDENPGLQLI<br>IRNFWSHETRLPSNTLDRLLALNSLYSPKIEVHFLSLATNFLLEMTSMSPDYPNPMFEHP<br>LSECEFQEYTIDSDWRFRSTVLTPMFVETQASQGTLQTRTQEGSLSARWPVAGQIRATQQ<br>QHDFTLTQTADGRSSFDWLTGSSTDPLVDHTSPSSDSLLFAHKRSERLQRAPLKSVGPDF<br>GKKRLGLPGDEVDNKVKGAAGRTDLLRLRRRFMRDQEKLSLMYARKGVAEQKREKEIKSE<br>LKMKQDAQVVLYRSYRHGDLPDIQIKHSSLITPLQAVAQRDPIIAKQLFSSLFSGILKEM<br>DKFKTLSEKNNITQKLLQDFNRFLNTTFSFPPPFVSCIQDISCQHAALLSLDPAAVSAGC<br>LASLQQPVGIRLLEEALLRLLPAELPAKRVRGKARLPPDVLRWVELAKLYRSIGEYDVLR<br>GIFTSEIGTKQITQSALLAEARSDYSEAAKQYDEALNKQDWVDGEPTEAEKDFWELASLD<br>CYNHLAEWKSLEYCSTASIDSENPPDLNKIWSEPFYQETYLPYMIRSKLKLLLQGEADQS<br>LLTFIDKAMHGELQKAILELHYSQELSLLYLLQDDVDRAKYYIQNGIQSFMQNYSSIDVL<br>LHQSRLTKLQSVQALTEIQEFISFISKQGNLSSQVPLKRLLNTWTNRYPDAKMDPMNIWD<br>DIITNRCFFLSKIEEKLTPLPEDNSMNVDQDGDPSDRMEVQEQEEDISSLIRSCKFSMKM<br>KMIDSARKQNNFSLAMKLLKELHKESKTRDDWLVSWVQSYCRLSHCRSRSQGCSEQVLTV<br>LKTVSLLDENNVSSYLSKNILAFRDQNILLGTTYRIIANALSSEPACLAEIEEDKARRIL |

TABLE VI.7-continued

Factors that promote canonical NHEJ

| Factor | Sequence |
|---|---|
| | ELSGSSSEDSEKVIAGLYQRAFQHLSEAVQAAEEEAQPPSWSCGPAAGVIDAYMTLADFC<br>DQQLRKEEENASVIDSAELQAYPALVVEKMLKALKLNSNEARLKFPRLLQIIERYPEETL<br>SLMTKEISSVPCWQFISWISHMVALLDKDQAVAVQHSVEEITDNYPQAIVYPFIISSESY<br>SFKDTSTGHKNKEFVARIKSKLDQGGVIQDFINALDQLSNPELLFKDWSNDVRAELAKTP<br>VNKKNIEKMYERMYAALGDPKAPGLGAFRRKFIQTFGKEFDKHFGKGGSKLLRMKLSDFN<br>DITNMLLLKMNKDSKPPGNLKECSPWMSDFKVEFLRNELEIPGQYDGRGKPLPEYHVRIA<br>GFDERVTVMASLRRPKRIIIRGHDEREHPFLVKGGEDLRQDQRVEQLFQVMNGILAQDSA<br>CSQRALQLRTYSVVPMTSSDPRAPPCEYKDWLTKMSGKHDVGAYMLMYKGANRTETVTSF<br>RKRESKVPADLLKRAFVRMSTSPEAFLALRSHFASSHALICISHWILGIGDRHLNNFMVA<br>METGGVIGIDFGHAFGSATQFLPVPELMPFRLTRQFINLMLPMKETGLMYSIMVHALRAF<br>RSDPGLLTNTMDVFVKEPSFDWKNFEQKMLKKGGSWIQEINVAEKNWYPRQKICYAKRKL<br>AGANPAVITCDELLLGHEKAPAFRDYVAVARGSKDHNIRAQEPESGLSEETQVKCLMDQA<br>TDPNILGRTWEGWEPWM |
| 53BP1 | >sp\|Q12888\|TP53B_HUMAN Tumor suppressor p53-binding protein 1<br>OS = Homo sapiens GN = TP53BP1 PE = 1 SV = 2<br>MDPTGSQLDSDFSQQDTPCLIIEDSQPESQVLEDDSGSHFSMLSRHLPNLQTHKENPVLD<br>VVSNPEQTAGEERGDGNSGFNEHLKENKVADPVDSSNLDTCGSISQVIEQLPQPNRTSSV<br>LGMSVESAPAVEEEKGEELEQKEKEKEEDTSGNTTHSLGAEDTASSQLGFGVLELSQSQD<br>VEENTVPYEVDKEQLQSVTTNSGYTRLSDVDANTAIKHEEQSNEDIPIAEQSSKDIPVTA<br>QPSKDVHVVKEQNPPPARSEDMPFSPKASVAAMEAKEQLSAQELMESGLQIQKSPEPEVL<br>STQEDLFDQSNKTVSSDGCSTPSREEGGCSLASTPATTLHLLQLSGQRSLVQDSLSTNSS<br>DLVAPSPDAFRSTPFIVPSSPTEQEGRQDKPMDTSVLSEEGGEPFQKKLQSGEPVELENP<br>PLLPESTVSPQASTPISQSTPVFPPGSLPIPSQPQFSHDIFIPSPSLEEQSNDGKKDGDM<br>HSSSLTVECSKTSEIEPKNSPEDLGLSLTGDSCKLMLSTSEYSQSPKMESLSSHRIDEDG<br>ENTQIEDTEPMSPVLNSKFVPAENDSILMNPAQDGEVQLSQNDDKTKGDDTDTRDDISIL<br>ATGCKGREETVAEDVCIDLTCDSGSQAVPSPATRSEALSSVLDQEEAMEIKEHHPEEGSS<br>GSEVEEIPETPCESQGEELKEENMESVPLHLSLTETQSQGLCLQKEMPKKECSEAMEVET<br>SVISIDSPQKLAILDQELEHKEQEAWEEEATSEDSSVVIVDVKEPSPRVDVSCEPLEGVEK<br>CSDSQSWEDIAPEIEPCAENRLDTKEEKSVEYEGDLKSGTAETEPVEQDSSQPSLPLVRA<br>DDPLRLDQELQQPQTQEKTSNSLTEDSKMANAKQLSSDAEAQKLGKPSAHASQSFCESSS<br>ETPFHFTLPKEGDIIPPLTGATPPLIGHLKLEPKRHSTPIGISNYPESTIATSDVMSESM<br>VETHDPILGSGKGDSGAAPDVDDKLCLRMKLVSPETEASEESLQFNLEKPATGERKNGST<br>AVAESVASPQKTMSVLSCICEARQENEARSEDPPTTPIRGNLLHFPSSQGEEEKEKLEGD<br>HTIRQSQQPMKPISPVKDPVSPASQKMVIQGPSSPQGEAMVTDVLEDQKEGRSTNKENPS<br>KALIERPSQNNIGIQTMECSLRVPETVSAATQTIKNVCEQGTSTVDQNFGKQDATVQTER<br>GSGEKPVSAPGDDTESLHSQGEEEFDMPQPPHGHVLRHHMRTIREVRTLVTRVITDVYYV<br>DGTEVERKVTEETEEPIVECQECETEVSPSQTGGSSGDLGDISSFSSKASSLHRTSSGTS<br>LSAMHSSGSSGKGAGPLRGKTSGTEPADFALPSSRGGPGKLSPRKGVSQTGTPVCEEDGD<br>AGLGIRQGGKAPVTPRGRGRRGRPPSRTTGTRETAVPGPLGIEDISPNLSPDDKSFSRVV<br>PRVPDSTRRTDVGAGALRRSDSPEIPFQAAAGPSDGLDASSPGNSFVGLRVVAKWSSNGY<br>FYSGKITRDVGAGKYKLLFDDGYECDVLGKDILLCDPIPLDTEVTALSEDEYFSAGVVKG<br>HRKESGELYYSIEKEGQRKWYKRMAVILSLEQGNRLREQYGLGPYEAVTPLTKAADISLD<br>NLVEGKRKRRSNVSSPATPTASSSSSTTPTRKITESPRASMGVLSGKRKLITSEEERSPA<br>KRGRKSATVKPGAVGAGEFVSPCESGDNTGEPSALEEQRGPLPLNKTLFLGYAFLLTMAT<br>TSDKLASRSKLPDGPTGSSEEEEEFLEIPPFNKQYTESQLRAGAGYILEDFNEAQCNTAY<br>QCLLIADQHCRTRKYFLCLASGIPCVSHVWVHDSCHANQLQNYRNYLLPAGYSLEEQRIL<br>DWQPRENPFQNLKVLLVSDQQQNFLELWSEILMTGGAASVKQHHSSAHNKDIALGVFDVV<br>VTDPSCPASVLKCAEALQLPVVSQEWVIQCLIVGERIGFKQHPKYKHDYVSH<br>>sp\|Q12888-2\|TP53B_HUMAN Isoform 2 of Tumor suppressor p53-<br>binding protein 1 OS = Homo sapiens GN = TP53BP1<br>MPGEQMDPTGSQLDSDFSQQDTPCLIIEDSQPESQVLEDDSGSHFSMLSRHLPNLQTHKE<br>NPVLDVVSNPEQTAGEERGDGNSGFNEHLKENKVADPVDSSNLDTCGSISQVIEQLPQPN<br>RTSSVLGMSVESAPAVEEEKGEELEQKEKEKEEDTSGNTTHSLGAEDTASSQLGFGVLEL<br>SQSQDVEENTVPYEVDKEQLQSVTTNSGYTRLSDVDANTAIKHEEQSNEDIPIAEQSSKD<br>IPVTAQPSKDVHVVKEQNPPPARSEDMPFSPKASVAAMEAKEQLSAQELMESGLQIQKSP<br>EPEVLSTQEDLFDQSNKTVSSDGCSTPSREEGGCSLASTPATTLHLLQLSGQRSLVQDSL<br>STNSSDLVAPSPDAFRSTPFIVPSSPTEQEGRQDKPMDTSVLSEEGGEPFQKKLQSGEPV<br>ELENPPLLPESTVSPQASTPISQSTPVFPPGSLPIPSQPQFSHDIFIPSPSLEEQSNDGK<br>KDGDMHSSSLTVECSKTSEIEPKNSPEDLGLSLTGDSCKLMLSTSEYSQSPKMESLSSHR<br>IDEDGENTQIEDTEPMSPVLNSKFVPAENDSILMNPAQDGEVQLSQNDDKTKGDDTDTRD<br>DISILATGCKGREETVAEDVCIDLTCDSGSQAVPSPATRSEALSSVLDQEEAMEIKEHHP<br>EEGSSGSEVEEIPETPCESQGEELKEENMESVPLHLSLTETQSQGLCLQKEMPKKECSEA<br>MEVETSVISIDSPQKLAILDQELEHKEQEAWEEEATSEDSSVVIVDVKEPSPRVDVSCEPL<br>EGVEKCSDSQSWEDIAPEIEPCAENRLDTKEEKSVEYEGDLKSGTAETEPVEQDSSQPSL<br>PLVRADDPLRLDQELQQPQTQEKTSNSLTEDSKMANAKQLSSDAEAQKLGKPSAHASQSF<br>CESSSETPFHFTLPKEGDIIPPLTGATPPLIGHLKLEPKRHSTPIGISNYPESTIATSDV<br>MSESMVETHDPILGSGKGDSGAAPDVDDKLCLRMKLVSPETEASEESLQFNLEKPATGER<br>KNGSTAVAESVASPQKTMSVLSCICEARQENEARSEDPPTTPIRGNLLHFPSSQGEEEKE<br>KLEGDHTIRQSQQPMKPISPVKDPVSPASQKMVIQGPSSPQGEAMVTDVLEDQKEGRSTN<br>KENPSKALIERPSQNNIGIQTMECSLRVPETVSAATQTIKNVCEQGTSTVDQNFGKQDAT<br>VQTERGSGEKPVSAPGDDTESLHSQGEEEFDMPQPPHGHVLRHHMRTIREVRTLVTRVIT<br>DVYYVDGTEVERKVTEETEEPIVECQECETEVSPSQTGGSSGDLGDISSFSSKASSLHRT<br>SSGTSLSAMHSSGSSGKGAGPLRGKTSGTEPADFALPSSRGGPGKLSPRKGVSQTGTPVC<br>EEDGDAGLGIRQGGKAPVTPRGRGRRGRPPSRTTGTRETAVPGPLGIEDISPNLSPDDKS<br>FSRVVPRVPDSTRRTDVGAGALRRSDSPEIPFQAAAGPSDGLDASSPGNSFVGLRVVAKW |

TABLE VI.7-continued

Factors that promote canonical NHEJ

| Factor | Sequence |
|---|---|
| | SSNGYFYSGKITRDVGAGKYKLLFDDGYECDVLGKDILLCDPIPLDTEVTALSEDEYFSA<br>GVVKGHRKESGELYYSIEKEGQRKWYKRMAVILSLEQGNRLREQYGLGPYEAVTPLTKAA<br>DISLDNLVEGKRKRRSNVSSPATPTASSSSSTTPTRKITESPRASMGVLSGKRKLITSEE<br>ERSPAKRGRKSATVKPGAVGAGEFVSPCESGDNTGEPSALEEQRGPLPLNKTLFLGYAFL<br>LTMATTSDKLASRSKLPDGPTGSSEEEEEFLEIPPFNKQYTESQLRAGAGYILEDFNEAQ<br>CNTAYQCLLIADQHCRTRKYFLCLASGIPCVSHVWVHDSCHANQLQNYRNYLLPAGYSLE<br>EQRILDWQPRENPFQNLKVLLVSDQQQNFLELWSEILMTGGAASVKQHHSSAHNKDIALG<br>VFDVVVTDPSCPASVLKCAEALQLPVVSQEWVIQCLIVGERIGFKQHPKYKHDYVSH<br>>sp\|Q12888-3\|TP53B_HUMAN Isoform 3 of Tumor suppressor p53-<br>binding protein 1 OS = Homo sapiens GN = TP53BP1<br>MPGEQMDPTGSQLDSDFSQQDTPCLIIEDSQPESQVLEDDSGSHFSMLSRHLPNLQTHKE<br>NPVLDVVSNPEQTAGEERGDGNSGFNEHLKENKVADPVDSSNLDTCGSISQVIEQLPQPN<br>RTSSVLGMSVESAPAVEEEKGEELEQKEKEKEEDTSGNTTHSLGAEDTASSQLGFGVLEL<br>SQSQDVEENTVPYEVDKEQLQSVTTNSGYTRLSDVDANTAIKHEEQSNEDIPIAEQSSKD<br>IPVTAQPSKDVHVVKEQNPPPARSEDMPFSPKASVAAMEAKEQLSAQELMESGLQIQKSP<br>EPEVLSTQEDLFDQSNKTVSSDGCSTPSREEGGCSLASTPATTLHLLQLSGQRSLVQDSL<br>STNSSDLVAPSPDAFRSTPFIVPSSPTEQEGRQDKPMDTSVLSEEGGEPFQKKLQSGEPV<br>ELENPPLLPESTVSPQASTPISQSTPVFPPGSLPIPSQPQFSHDIFIPSPSLEEQSNDGK<br>KDGDMHSSSLTVECSKTSEIEPKNSPEDLGLSLTGDSCKLMLSTSEYSQSPKMESLSSHR<br>IDEDGENTQIEDTEPMSPVLNSKFVPAENDSILMNPAQDGEVQLSQNDDKTKGDDTDTRD<br>DISILATGCKGREETVAEDVCIDLTCDSGSQAVPSPATRSEALSSVLDQEEAMEIKEHHP<br>EEGSSGSEVEEIPETPCESQGEELKEENMESVPLHLSLTETQSQGLCLQKEMPKKECSEA<br>MEVETSVISIDSPQKLAILDQELEHKEQEAWEEATSEDSSVVIVDVKEPSPRVDVSCEPL<br>EGVEKCSDSQSWEDIAPEIEPCAENRLDTKEEKSVEYEGDLKSGTAETEPVEQDSSQPSL<br>PLVRADDPLRLDQELQQPQTQEKTSNSLTEDSKMANAKQLSSDAEAQKLGKPSAHASQSF<br>CESSSETPFHFTLPKEGDIIPPLTGATPPLIGHLKLEPKRHSTPIGISNYPESTIATSDV<br>MSESMVETHDPILGSGKGDSGAAPDVDDKLCLRMKLVSPETEASEESLQFNLEKPATGER<br>KNGSTAVAESVASPQKTMSVLSCICEARQENEARSEDPPTTPIRGNLLHFPSSQGEEEKE<br>KLEGDHTIRQSQPPMKPISPVKDPVSPASQKMVIQGPSSPQGEAMVTDVLEDQKEGRSTN<br>KENPSKALIERPSQNNIGIQTMECSLRVPETVSAATQTIKNVCEQGTSTVDQNFGKQDAT<br>VQTERGSGEKPVSAPGDDTESLHSQGEEEFDMPQPPHGHVLHRHMRTIREVRTLVTRVIT<br>DVYYVDGTEVERKVTEETEEPIVECQECETEVSPSQTGGSSGDLGDISSFSSKASSLHRT<br>SSGTSLSAMHSSGSSGKGAGPLRGKTSGTEPADFALPSSRGGPGKLSPRKGVSQTGTPVC<br>EEDGDAGLGIRQGGKAPVTPRGRGRRGRPPSRTTGTRETAVPGPLGIEDISPNLSPDDKS<br>FSRVVPRVPDSTRRTDVGAGALRRSDSPEIPFQAAAGPSDGLDASSPGNSFVGLRVVAKW<br>SSNGYFYSGKITRDVGAGKYKLLFDDGYECDVLGKDILLCDPIPLDTEVTALSEDEYFSA<br>GVVKGHRKESGELYYSIEKEGQRKWYKRMAVILSLEQGNRLREQYGLGPYEAVTPLTKAA<br>DISLDNLVEGKRKRRSNVSSPATPTASSSSSTTPTRKITESPRASMGVLSGKRKLITSEE<br>ERSPAKRGRKSATVKPVGAGEFVSPCESGDNTGEPSALEEQRGPLPLNKTLFLGYAFLLT<br>MATTSDKLASRSKLPDGPTGSSEEEEEFLEIPPFNKQYTESQLRAGAGYILEDFNEAQCN<br>TAYQCLLIADQHCRTRKYFLCLASGIPCVSHVWVHDSCHANQLQNYRNYLLPAGYSLEEQ<br>RILDWQPRENPFQNLKVLLVSDQQQNFLELWSEILMTGGAASVKQHHSSAHNKDIALGVF<br>DVVVTDPSCPASVLKCAEALQLPVVSQEWVIQCLIVGERIGFKQHPKYKHDYVSH |
| XRCC4 | >sp\|Q13426\|XRCC4_HUMAN DNA repair protein XRCC4<br>OS = Homo sapiens GN = XRCC4 PE = 1 SV = 2<br>MERKISRIHLVSEPSITHFLQVSWEKTLESGFVITLTDGHSAWTGTVSESEISQEADDMA<br>MEKGKYVGELRKALLSGAGPADVYTFNFSKESCYFFFEKNLKDVSFRLGSFNLEKVENPA<br>EVIRELICYCLDTIAENQAKNEHLQKENERLLRDWNDVQGRFEKCVSAKEALETDLYKRF<br>ILVLNEKKTKIRSLHNKLLNAAQEREKDIKQEGETAICSEMTADRDPVYDESTDEESENQ<br>TDLSGLASAAVSKDDSIISSLDVTDIAPSRKRRQRMQRNLGTEPKMAPQENQLQEKENSR<br>PDSSLPETSKKEHISAENMSLETLRNSSPEDLFDEI<br>>sp\|Q13426-2\|XRCC4_HUMAN Isoform 2 of DNA repair protein XRCC4<br>OS = Homo sapiens GN = XRCC4<br>MERKISRIHLVSEPSITHFLQVSWEKTLESGFVITLTDGHSAWTGTVSESEISQEADDMA<br>MEKGKYVGELRKALLSGAGPADVYTFNFSKESCYFFFEKNLKDVSFRLGSFNLEKVENPA<br>EVIRELICYCLDTIAENQAKNEHLQKENERLLRDWNDVQGRFEKCVSAKEALETDLYKRF<br>ILVLNEKKTKIRSLHNKLLNAAQEREKDIKQEGETAICSEMTADRDPVYDESTDEESENQ<br>TDLSGLASAAVSKDDSIISSLDVTDIAPSRKRRQRMQRNLGTEPKMAPQENQLQEKEKPD<br>SSLPETSKKEHISAENMSLETLRNSSPEDLFDEI<br>>sp\|Q13426-3\|XRCC4_HUMAN Isoform 3 of DNA repair protein XRCC4<br>OS = Homo sapiens GN = XRCC4<br>MERKISRIHLVSEPSITHFLQVSWEKTLESGFVITLTDGHSAWTGTVSESEISQEADDMA<br>MEKGKYVGELRKALLSGAGPADVYTFNFSKESCYFFFEKNLKDVSFRLGSFNLEKVENPA<br>EVIRELICYCLDTIAENQAKNEHLQKENERLLRDWNDVQGRFEKCVSAKEALETDLYKRF<br>ILVLNEKKTKIRSLHNKLLNAAQEREKDIKQEGETAICSEMTADRDPVYDESTDEESENQ<br>TDLSGLASAAVSKDDSIISSLDVTDIAPSRKRRQRMQRNLGTEPKMAPQENQLQEKEGR<br>KKETSEKEAV |
| LIG4 | >sp\|P49917\|DNLI4_HUMAN DNA ligase 4 OS = Homo sapiens<br>GN = LIG4 PE = 1 SV = 2<br>MAASQTSQTVASHVPFADLCSTLERIQKSKGRAEKIRHFREFLDSWRKFHDALHKNHKDV<br>TDSFYPAMRLILPQLERERMAYGIKETMLAKLYIELLNLPRDGKDALKLLNYRIPTGTHG<br>DAGDFAMIAYFVLKPRCLQKGSLTIQQVNDLLDSIASNNSAKRKDLIKKSLLQLITQSSA<br>LEQKWLIRMIIKDLKLGVSQQTIFSVFHNDAAELHNVTTDLEKVCRQLHDPSVGLSDISI<br>TLFSAFKPMLAAIADIEHIEKDMKHQSFYIETKLDGERMQMHKDGDVYKYFSRNGYNYTD |

TABLE VI.7-continued

Factors that promote canonical NHEJ

| Factor | Sequence |
|---|---|
| | QFGASPTEGSLIPFIHNAFKADIQICILDGEMMAYNPNIQTFMQKGTKFDIKRMVEDSDL<br>QTCYCVFDVLMVNNKKLGHETLRKRYEILSSIFTPIPGRIEIVQKTQAHTKNEVIDALNE<br>AIDKREEGIMVKQPLSIYKPDKRGEGWLKIKPEYVSGLMDELDILIVGGYWGKGSRGGMM<br>SHFLCAVAEKPPPGEKPSVFHTLSRVGSGCTMKELYDLGLKLAKYWKPFHRKAPPSSILC<br>GTEKPEVYIEPCNSVIVQIKAAEIVPSDMYKTGCTLRFPRIEKIRDDKEWHECMTLDDLE<br>QLRGKASGKLASKHLYIGGDDEPQEKKRKAAPKMKKVIGIIEHLKAPNLTNVNKISNIFE<br>DVEFCVMSGTDSQPKPDLENRIAEFGGYIVQNPGPDTYCVIAGSENIRVKNIILSNKHDV<br>VKPAWLLECFKTKSFVPWQPRFMIHMCPSTKEHFAREYDCYGDSYFIDTDLNQLKEVFSG<br>IKNSNEQTPEEMASLIADLEYRYSWDCSPLSMFRRHTVYLDSYAVINDLSTKNEGTRLAI<br>KALELRFHGAKVVSCLAEGVSHVIIGEDHSRVADFKAFRRTFKRKFKILKESWVTDSIDK<br>CELQEENQYLI |
| XLF (also called NHEJ1) | >sp\|Q9H9Q4\|NHEJ1_HUMAN Non-homologous end-joining factor 1<br>OS = Homo sapiens GN = NHEJ1 PE = 1 SV = 1<br>MEELEQGLLMQPWAWLQLAENSLLAKVFITKQGYALLVSDLQQVWHEQVDTSVVSQRAKE<br>LNKRLTAPPAAFLCHLDNLLRPLLKDAAHPSEATFSCDCVADALILRVRSELSGLPFYWN<br>FHCMLASPSLVSQHLIRPLMGMSLALQCQVRELATLLHMKDLEIQDYQESGATLIRDRLK<br>TEPFEENSFLEQFMIEKLPEACSIGDGKPFVMNLQDLYMAVTTQEVQVGQKHQGAGDPHT<br>SNSASLQGIDSQCVNQPEQLVSSAPTLSAPEKESTGTSGPLQRPQLSKVKRKKPRGLFS<br>>sp\|Q9H9Q4-2\|NHEJ1_HUMAN Isoform 2 of Non-homologous end-joining<br>factor 1 OS = Homo sapiens GN = NHEJ1<br>MEELEQGLLMQPWAWLQLAENSLLAKVFITKQGYALLVSDLQQVWHEQVDTSVVSQRAKE<br>LNKRLTAPPAAFLCHLDNLLRPLLKDAAHPSEATFSCDCVADALILRVRSELSGLPFYWN<br>FHCMLASPSLVSQHLIRPLMGMSLALQCQVRELATLLHMKDLEIQDYQESGATLIRDRLK<br>TEPFEENSFLEQFMIEKLPEACSIGDGKPFVMNLQDLYMAVTTQEVQVGQKHQGAGDPHT<br>SNSASLQGIDSQCVNQPEQLVSSAPTLSAPEKESTALCRDLSCQRSRGRSQGVSSVNLLW<br>PQLLRMDLENSFQASP |
| ARTEMIS | MSSFEGQMAEYPTISIDRFDRENLRARAYFLSHCHKDHMKGLRAPTLKRRLECSLKVYLY<br>CSPVTKELLLTSPKYRFWKKRIISIEIETPTQISLVDEASGEKEEIVVTLLPAGHCPGSV<br>MPLFQGNNGTVLYTGDFRLAQGEAARMELLHSGGRVKDIQSVYLDTTFCDPRFYQIPSRE<br>ECLSGVLELVRSWITRSPYHVVWLNCKAAYGYEYLFTNLSEELGVQVHVNKLDMFRNMPE<br>ILHHLTTDRNTQIHACRHPKAEEYFQWSKLPCGITSRNRIPLHIISIKPSTMWFGERSRK<br>TNVIVRTGESSYRACFSFHSSYSEIKDFLSYLCPVNAYPNVIPVGTTMDKVVEILKPLCR<br>SSQSTEPKYKPLGKLKRARTVHRDSEEEDDYLFDDPLPIPLRHKVPYPETFHPEVFSMTA<br>VSEKQPEKLRQTPGCCRAECMQSSRFTNFVDCEESNSESEEEVGIPASLQGDLGSVLHLQ<br>KADGDVPQWEVFFKRNDEITDESLENFPSSTVAGGSQSPKLFSDSDGESTHISSQNSSQS<br>THITEQGSQGWDSQSDTVLLSSQERNSGDITSLDKADYRPTIKENIPASLMEQNVICPKD<br>TYSDLKSRDKDVTIVPSTGEPTTLSSETHIPEEKSLLNLSTNADSQSSSDFEVPSTPEAE<br>LPKREHLQYLYEKLATGESIAVKKRKCSLLDT (Artemis Isoform 1 CCDS 31149.1)<br>MKHQERFLFQGNNGTVLYTGDFRLAQGEAARMELLHSGGRVKDIQSVYLDTTFCDPRFYQ<br>IPSREECLSGVLELVRSWITRSPYHVVWLNCKAAYGYEYLFTNLSEELGVQVHVNKLDMF<br>RNMPEILHHLTTDRNTQIHACRHPKAEEYFQWSKLPCGITSRNRIPLHIISIKPSTMWFG<br>ERSRKTNVIVRTGESSYRACFSFHSSYSEIKDFLSYLCPVNAYPNVIPVGTTMDKVVEIL<br>KPLCRSSQSTEPKYKPLGKLKRARTVHRDSEEEDDYLFDDPLPIPLRHKVPYPETFHPEV<br>FSMTAVSEKQPEKLRQTPGCCRAECMQSSRFTNFVDCEESNSESEEEVGIPASLQGDLGS<br>VLHLQKADGDVPQWEVFFKRNDEITDESLENFPSSTVAGGSQSPKLFSDSDGESTHISSQ<br>NSSQSTHITEQGSQGWDSQSDTVLLSSQERNSGDITSLDKADYRPTIKENIPASLMEQNV<br>ICPKDTYSDLKSRDKDVTIVPSTGEPTTLSSETHIPEEKSLLNLSTNADSQSSSDFEVPS<br>TPEAELPKREHLQYLYEKLATGESIAVKKRKCSLLDT (Artemis Isoform 2 CCDS<br>7105.1)<br>MPLFQGNNGTVLYTGDFRLAQGEAARMELLHSGGRVKDIQSVYLDTTFCDPRFYQIPSRE<br>ECLSGVLELVRSWITRSPYHVVWLNCKAAYGYEYLFTNLSEELGVQVHVNKLDMFRNMPE<br>ILHHLTTDRNTQIHACRHPKAEEYFQWSKLPCGITSRNRIPLHIISIKPSTMWFGERSRK<br>TNVIVRTGESSYRACFSFHSSYSEIKDFLSYLCPVNAYPNVIPVGTTMDKVVEILKPLCR<br>SSQSTEPKYKPLGKLKRARTVHRDSEEEDDYLFDDPLPIPLRHKVPYPETFHPEVFSMTA<br>VSEKQPEKLRQTPGCCRAECMQSSRFTNFVDCEESNSESEEEVGIPASLQGDLGSVLHLQ<br>KADGDVPQWEVFFKRNDEITDESLENFPSSTVAGGSQSPKLFSDSDGESTHISSQNSSQS<br>THITEQGSQGWDSQSDTVLLSSQERNSGDITSLDKADYRPTIKENIPASLMEQNVICPKD<br>TYSDLKSRDKDVTIVPSTGEPTTLSSETHIPEEKSLLNLSTNADSQSSSDFEVPSTPEAE<br>LPKREHLQYLYEKLATGESIAVKKRKCSLLDT (Artemis Isoform 3 CCDS 31150.1) |
| APLF | >sp\|Q8IW19\|APLF_HUMAN Aprataxin and PNK-like factor OS = Homo<br>sapiens GN = APLF PE = 1 SV = 1<br>MSGGFELQPRDGGPRVALAPGETVIGRGPLLGITDKRVSRRHAILEVAGGQLRIKPIHTN<br>PCFYQSSEKSQLLPLKPNLWCYLNPGDSFSLLVDKYIFRILSIPSEVEMQCTLRNSQVLD<br>EDNILNETPKSPVINLPHETTGASQLEGSTEIAKTQMTPTNSVSFLGENRDCNKQQPILA<br>ERKRILPTWMLAEHLSDQNLSVPAISGGNVIQGSGKEEICKDKSQLNTTQQGRRQLISSG<br>SSENTSAEQDTGEECKNTDQEESTISSKEMPQSFSAITLSNTEMNNIKTNAQRNKLPIEE<br>LGKVSKHKIATKRIPHKEDEAMSCSENCSSAQGDSLQDESQGSHSESSSNPSNPETLHAK<br>ATDSVLQGSEGNKVKRTSCMYGANCYRKNPVHFQHFSHPGDSDYGGVQIVGQDETDDRPE<br>CPYGPSCYRKNPQHKIEYRHNTLPVRNVLDEDNDNVGQPNEYDLNDSFLDDEEEDYEPTD<br>EDSDWEPGKEDEEKEDVEELLKEAKRFMKRK |

TABLE VI.7-continued

Factors that promote canonical NHEJ

| Factor | Sequence |
| --- | --- |
| PNK (also called PNKP) | >sp\|Q96T60\|PNKP_HUMAN Bifunctional polynucleotide phosphatase/kinase OS = Homo sapiens GN = PNKP PE = 1 SV = 1<br>MGEVEAPGRLWLESPPGGAPPIFLPSDGQALVLGRGPLTQVTDRKCSRTQVELVADPETR<br>TVAVKQLGVNPSTTGTQELKPGLEGSLGVGDTLYLVNGLHPLTLRWEETRTPESQPDTPP<br>GTPLVSQDEKRDAELPKKRMRKSNPGWENLEKLLVFTAAGVKPQGKVAGFDLDGTLITTR<br>SGKVFPTGPSDWRILYPEIPRKLRELEAEGYKLVIFTNQMSIGRGKLPAEEFKAKVEAVV<br>EKLGVPFQVLVATHAGLYRKPVTGMWDHLQEQANDGTPISIGDSIFVGDAAGRPANWAPG<br>RKKKDFSCADRLFALNLGLPFATPEEFFLKWPAAGFELPAFDPRTVSRSGPLCLPESRAL<br>LSASPEVVVAVGFPGAGKSTFLKKHLVSAGYVHVNRDTLGSWQRCVTTCETALKQGKRVA<br>IDNTNPDAASRARYVQCARAAGVPCRCFLFTATLEQARHNNRFREMTDSSHIPVSDMVMY<br>GYRKQFEAPTLAEGFSAILEIPFRLWVEPRLGRLYCQFSEG<br>>sp\|Q96T60-2\|PNKP_HUMAN Isoform 2 of Bifunctional polynucleotide phosphatase/kinase OS = Homo sapiens GN = PNKP<br>MQILTPPLQSSVELVADPETRTVAVKQLGVNPSTTGTQELKPGLEGSLGVGDTLYLVNGL<br>HPLTLRWEETRTPESQPDTPPGTPLVSQDEKRDAELPKKRMRKSNPGWENLEKLLVFTAA<br>GVKPQGKVAGFDLDGTLITTRSGKVFPTGPSDWRILYPEIPRKLRELEAEGYKLVIFTNQ<br>MSIGRGKLPAEEFKAKVEAVVEKLGVPFQVLVATHAGLYRKPVTGMWDHLQEQANDGTPI<br>SIGDSIFVGDAAGRPANWAPGRKKKDFSCADRLFALNLGLPFATPEEFFLKWPAAGFELP<br>AFDPRIVSRSGPLCLPESRALLSASPEVVVAVGFPGAGKSTFLKKHLVSAGYVHVNRDIL<br>GSWQRCVTTCETALKQGKRVAIDNTNPDAASRARYVQCARAAGVPCRCFLFTATLEQARH<br>NNRFREMIDSSHIPVSDMVMYGYRKQFEAPTLAEGFSAILEIPFRLWVEPRLGRLYCQFS<br>EG |
| Rif1 | >sp\|Q5UIP0\|RIF1_HUMAN Telomere-associated protein RIF1 OS = Homo sapiens GN = RIF1 PE = 1 SV = 2<br>MTARGQSPLAPLLETLEDPSASHGGQTDAYLTLTSRMTGEEGKEVITEIEKKLPRLYKVL<br>KTHISSQNSELSSAALQALGFCLYNPKITSELSEANALELLSKLNDTIKNSDKNVRTRAL<br>WVISKQTFPSEVVGKMVSSIIDSLEILFNKGETHSAVVDFEALNVIVRLIEQAPIQMGEE<br>AVRWAKLVIPLVVHSAQKVHLRGATALEMGMPLLLQKQQEIASITEQLMTTKLISELQKL<br>FMSKNETYVLKLWPLFVKLLGRTLHRSGSFINSLLQEELGFRSGAPMIKKIAFIAWKSL<br>IDNFALNPDILCSAKRLKLLMQPLSSIHVRTETLALTKLEVWWYLLMRLGPHLPANFEQV<br>CVPLIQSTISIDSNASPQGNSCHVATSPGLNPMTPVHKGASSPYGAPGTPRMNLSSNLGG<br>MATIPSIQLLGLEMLLHFLLGPEALSFAKQNKLVLSLEPLEHPLISSPSFFSKHANTLIT<br>AVHDSFVAVGKDAPDVVVSAIWKELISLVKSVTESGNKKEKPGSEVLTLLLKSLESIVKS<br>EVFPVSKTLVLMEITIKGLPQKVLGSPAYQVANMDILNGTPALFLIQLIFNNFLECGVSD<br>ERFFLSLESLVGCVLSGPTSPLAFSDSVLNVINQNAKQLENKEHLWKMWSVIVTPLTELI<br>NQTNEVNQGDALEHNFSAIYGALTLPVNHIFSEQRFPVATMKTLLRTWSELYRAFARCAA<br>LVATAEEENLCCEELSSKIMSSLEDEGFSNLLFVDRIIYIITVMVDCIDFSPYNIKYQPKV<br>KSPQRPSDWSKKKNEPLGKLTSLFKLIVKVIYSFHTLSFKEAHSDTLFTIGNSITGIISS<br>VLGHISLPSMIRKIFATLTRPLALFYENSKLDEVPKVYSCLNNKLEKLLGETIACLQFSY<br>TGTYDSELLEQLSPLLCIIFLHKNKQIRKQSAQFWNATFAKVMMLVYPEELKPVLTQAKQ<br>KFLLLLPGLETVEMMEESSGPYSDGTENSQLNVKISGMERKSNGKRDSFLAQTKNKKENM<br>KPAAKLKLESSSLKVKGEILLEEEKSTDFVFIPPEGKDAKERILTDHQKEVLKTKRCDIP<br>AMYNNLDVSQDTLFTQYSQEEPMEIPTLTRKPKEDSKMMITEEQMDSDIVIPQDVTEDCG<br>MAEHLEKSSLSNNECGSLDKISPEMSNSNNDERKKALISSRKTSTECASSTENSFVVSSS<br>SVSNTTVAGTPPYPTSRRQTFITLEKFDGSENRPFSPSPLNNISSTVTVKNNQETMIKTD<br>FLPKAKQREGTFSKSDSEKIVNGTKRSSRRAGKAEQTGNKRSKPLMRSEPEKNTEESVEG<br>IVVLENNPPGLLNQTECVSDNQVHLSESTMEHDNTKLKAATVENAVLLETNTVEEKNVEI<br>NLESKENTPPVVISADQMVNEDSQVQIIPNQKTLRRSSRRRSEVVESTTESQDKENSHQK<br>KERRKEEEKPLQKSPLHIKDDVLPKQKLIAEQTLQENLIEKGSNLHEKTLGETSANAETE<br>QNKKKADPENIKSEGDGTQDIVDKSSEKLVRGRTRYQTRRASQGLLSSIENSESDSSEAK<br>EEGSRKKRSGKWKNKSNESVDIQDQEEKVVKQECIKAENQSHDYKATSEEDVSIKSPICE<br>KQDESNTVICQDSTVTSDLLQVPDDLPNVCEEKNETSKYAEYSFTSLPVPESNLRTRNAI<br>KRLHKRDSFDNCSLGESSKIGISDISSLSEKTFQTLECQHKRSRRVRRSKGCDCCGEKSQ<br>PQEKSLIGLKNTENNDVEISETKKADVQAPVSPSETSQANPYSEGQFLDEHHSVNPHLGL<br>KEDNDTINDSLIVSETKSKENTMQESLPSGIVNFREEICDMDSSEAMSLESQESPNENFK<br>TVGPCLGDSKNVSQESLETKEEKPEETPKMELSLENVTVEGNACKVTESNLEKAKTMELN<br>VGNEASFHGQERTKTGISEEAAIEENKRNDDSEADTAKLNAKEVATEEFNSDISLSDNTT<br>PVKLNAQTEISEQTAAGELDGGNDVSDLHSSEETNIKMKNNEEMMIGEAMAEIGHDGETE<br>NEGITTKTSKPDEAETNMLTAEMDNFVCDTVEMSTEEGIIDANKTETNTEYSKSEEKLDN<br>NQMVMESDILQEDHHTSQKVEEPSQCLASGTAISELIIEDNNASPQKLRELDPSLVSAND<br>SPSGMQTRCVWSPLASPSTSILKRGLKRSQEDEISSPVNKVRRVSFADPIYQAGLADDID<br>RRCSIVRSHSSNSSPIGKSVKISPITQSKHNITSAKGFLSPGSRSPKFKSSKKCLISEMA<br>KESIPCPTESVYPPLVNCVAPVDIILPQITSNMWARGLGQLIRAKNIKTIGDLSTLTASE<br>IKTLPIRSPKVSNVKKALRIYHEQQVKTRGLEEIPVFDISEKTVNGIENKSLSPDEERLV<br>SDIIDPVALEIPLSKNLLAQISALALQLDSEDLHNYSGSQLFEMHEKLSCMANSVIKNLQ<br>SRWRSPSHENSI<br>>sp\|Q5UIP0-2\|RIF1_HUMAN Isoform 2 of Telomere-associated protein RIF1 OS = Homo sapiens GN = RIF1<br>MTARGQSPLAPLLETLEDPSASHGGQTDAYLTLTSRMTGEEGKEVITEIEKKLPRLYKVL<br>KTHISSQNSELSSAALQALGFCLYNPKITSELSEANALELLSKLNDTIKNSDKNVRTRAL<br>WVISKQTEPSEVVGKMVSSIIDSLEILFNKGETHSAVVDFEALNVIVRLIEQAPIQMGEE<br>AVRWAKLVIPLVVHSAQKVHLRGATALEMGMPLLLQKQQEIASITEQLMTTKLISELQKL<br>FMSKNETYVLKLWPLFVKLLGRTLHRSGSFINSLLQEELGFRSGAPMIKKIAFIAWKSL<br>IDNFALNPDILCSAKRLKLLMQPLSSIHVRTETLALTKLEVWWYLLMRLGPHLPANFEQV |

TABLE VI.7-continued

Factors that promote canonical NHEJ

| Factor | Sequence |
|---|---|
|  | CVPLIQSTISIDSNASPQGNSCHVATSPGLNPMTPVHKGASSPYGAPGTPRMNLSSNLGG<br>MATIPSIQLLGLEMLLHFLLGPEALSFAKQNKLVLSLEPLEHPLISSPSFFSKHANTLIT<br>AVHDSFVAVGKDAPDVVVSAIWKELISLVKSVTESGNKKEKPGSEVLTLLLKSLESIVKS<br>EVFPVSKTLVLMEITIKGLPQKVLGSPAYQVANMDILNGTPALFLIQLIFNNFLECGVSD<br>ERFFLSLESLVGCVLSGPTSPLAFSDSVLNVINQNAKQLENKEHLWKMWSVIVTPLTELI<br>NQTNEVNQGDALEHNFSAIYGALTLPVNHIFSEQRFPVATMKTLLRTWSELYRAFARCAA<br>LVATAEENLCCEELSSKIMSSLEDEGFSNLLFVDRIIYIITVMVDCIDFSPYNIKYQPKV<br>KSPQRPSDWSKKKNEPLGKLTSLFKLIVKVIYSFHTLSFKEAHSDTLFTIGNSITGIISS<br>VLGHISLPSMIRKIFATLTRPLALFYENSKLDEVPKVYSCLNNKLEKLLGETIACLQFSY<br>TGTYDSELLEQLSPLLCIIFLHKNKQIRKQSAQFWNATFAKVMMLVYPEELKPVLTQAKQ<br>KFLLLLPGLETVEMMEESSGPYSDGTENSQLNVKISGMERKSNGKRDSFLAQTKNKKENM<br>KPAAKLKLESSSLKVKGEILLEEEKSTDFVFIPPEGKDAKERILTDHQKEVLKTKRCDIP<br>AMYNNLDVSQDTLFTQYSQEEPMEIPTLTRKPKEDSKMMITEEQMDSDIVIPQDVTEDCG<br>MAEHLEKSSLSNNECGSLDKTSPEMSNSNNDERKKALISSRKTSTECASSTENSFVVSSS<br>SVSNTTVAGTPPYPTSRRQTFITLEKFDGSENRPFSPSPLNNISSTVTVKNNQETMIKTD<br>FLPKAKQREGTFSKSDSEKIVNGTKRSSRRAGKAEQTGNKRSKPLMRSEPEKNTEESVEG<br>IVVLENNPPGLLNQTECVSDNQVHLSESTMEHDNTKLKAATVENAVLLETNTVEEKNVEI<br>NLESKENTPPVVISADQMVNEDSQVQITPNQKTLRRSSRRRSEVVESTTESQDKENSHQK<br>KERRKEEEKPLQKSPLHIKDDVLPKQKLIAEQTLQENLIEKGSNLHEKTLGETSANAETE<br>QNKKKADPENIKSEGDGTQDIVDKSSEKLVRGRTRYQTRRASQGLLSSIENSESDSSEAK<br>EEGSRKKRSGKWKNKSNESVDIQDQEEKVVKQECIKAENQSHDYKATSEEDVSIKSPICE<br>KQDESNTVICQDSTVTSDLLQVPDDLPNVCEEKNETSKYAEYSFTSLPVPESNLRTRNAI<br>KRLHKRDSFDNCSLGESSKIGISDISSLSEKTFQTLECQHKRSRRVRRSKGCDCCGEKSQ<br>PQEKSLIGLKNTENNDVEISETKKADVQAPVSPSETSQANPYSEGQFLDEHHSVNFHLGL<br>KEDNDTINDSLIVSETKSKENTMQESLPSGIVNFREEICDMDSSEAMSLESQESPNENFK<br>TVGPCLGDSKNVSQESLETKEEKPEETPKMELSLENVTVEGNACKVTESNLEKAKTMELN<br>VGNEASFHGQERTKTGISEEAAIEENKRNDDSEADTAKLNAKEVATEEFNSDISLSDNTT<br>PVKLNAQTEISEQTAAGELDGGNDVSDLHSSEETNTKMKNNEEMMIGEAMAETGHDGETE<br>NEGITTKTSKPDEAETNMLTAEMDNFVCDTVEMSTEEGIIDANKTETNTEYSKSEEKLDN<br>NQMVMESDILQEDHHTSQKVEEPSQCLASGTAISELIIEDNNASPQKLRELDPSLVSAND<br>SPSGMQTRCVWSPLASPSTSILKRGLKRSQEDEISSPVNKVRRVSFADPIYQAGLADDID<br>RRCSIVRSHSSNSSPIGKSVKTSPTTQSKISEMAKESIPCPTESVYPPLVNCVAPVDIIL<br>PQITSNMWARGLGQLIRAKNIKTIGDLSTLTASEIKTLPIRSPKVSNVKKALRIYHEQQV<br>KTRGLEEIPVFDISEKTVNGIENKSLSPDEERLVSDIIDPVALEIPLSKNLLAQISALAL<br>QLDSEDLHNYSGSQLFEMHEKLSCMANSVIKNLQSRWRSPSHENSI |
| PTIP (also called PAXIP1) | >sp\|Q6ZW49\|PAXI1_HUMAN PAX-interacting protein 1 OS = Homo sapiens GN = PAXIP1 PE = 1 SV = 2<br>MSDQAPKVPEEMFREVKYYAVGDIDPQVIQLLKAGKAKEVSYNALASHIISEDGDNPEVG<br>EAREVFDLPVVKPSWVILSVQCGTLLPVNGFSPESCQIFFGITACLSQVSSEDRSALWAL<br>VTFYGGDCQLTLNKKCTHLIVPEPKGEKYECALKRASIKIVTPDWVLDCVSEKTKKDEAF<br>YHPRLIIYEEEEEEEEEEEVENEEQDSQNEGSTDEKSSPASSQEGSPSGDQQFSPKSNT<br>EKSKGELMFDDSSDSSPEKQERNLNWTPAEVPQLAAAKRRLPQGKEPGLINLCANVPPVP<br>GNILPPEVRGNLMAAGQNLQSSERSEMIATWSPAVRTLRNITNNADIQQMNRPSNVAHIL<br>QTLSAPTKNLEQQVNHSQQGHTNANAVLFSQVKVTPETHMLQQQQQAQQQQQQHPVLHLQ<br>PQQIMQLQQQQQQQISQQPYPQQPPHPFSQQQQQQQQAHPHQFSQQQLQFPQQQLHPPQQ<br>LHRPQQQLQPFQQQHALQQQFHQLQQHQLQQQQLAQLQQQHSLLQQQQQQQIQQQQLQRM<br>HQQQQQQQMQSQTAPHLSQTSQALQHQVPPQQPPQQQQQQQPPPSPQQHQLFGHDPAVEI<br>PEEGFLLGCVFAIADYPEQMSDKQLLATWKRITQAHGGTVDPTFTSRCTHLLCESQVSSA<br>YAQAIRERKRCVTAHWLNTVLKKKKMVPPHRALHFPVAFPPGGKPCSQHIISVTGFVDSD<br>RDDLKLMAYLAGAKYTGYLCRSNTVLICKEPTGLKYEKAKEWRIPCVNAQWLGDILLGNF<br>EALRQIQYSRYTAFSLQDPFAPTQHLVLNLLDAWRVPLKVSAELLMSIRLPPKLKQNEVA<br>NVQPSSKRARIEDVPPPTKKLTPELTPFVLFTGFEPVQVQQYIKKLYILGGEVAESAQKC<br>THLIASKVTRTVKFLTAISVVKHIVTPEWLEECFRCQKFIDEQNYILRDAEAEVLFSFSL<br>EESLKRAHVSPLFKAKYFYITPGICPSLSTMKAIVECAGGKVLSKQPSFRKLMEHKQNSS<br>LSEIILISCENDLHLCREYFARGIDVHNAEFVLTGVLTQTLDYESYKFN<br>>sp\|Q6ZW49-2\|PAXI1_HUMAN Isoform 3 of PAX-interacting protein 1 OS = Homo sapiens GN = PAXIP1<br>MFDDSSDSSPEKQERNLNWTPAEVPQLAAAKRRLPQGKEPGLINLCANVPPVPGNILPPE<br>VRGNLMAAGQNLQSSERSEMIATWSPAVRTLRNITNNADIQQMNRPSNVAHILQTLSAPT<br>KNLEQQVNHSQQGHTNANAVLFSQVKVTPETHMLQQQQQAQQQQQQHPVLHLQPQQIMQL<br>QQQQQQQISQQPYPQQPPHPFSQQQQQQQQAHPHQFSQQQLQFPQQQLHPPQQLHRPQQQ<br>LQPFQQQHALQQQFHQLQQHQLQQQQLAQLQQQHSLLQQQQQQQIQQQQLQRMHQQQQQQ<br>QMQSQTAPHLSQTSQALQHQVPPQQPPQQQQQQQPPPSPQQHQLFGHDPAVEIPEEGFLL<br>GCVFAIADYPEQMSDKQLLATWKRITQAHGGTVDPTFTSRCTHLLCESQVSSAYAQAIRE<br>RKRCVTAHWLNTVLKKKKMVPPHRALHFPVAFPPGGKPCSQHIISVTGFVDSDRDDLKLM<br>AYLAGAKYTGYLCRSNTVLICKEPTGLKYEKAKEWRIPCVNAQWLGDILLGNFEALRQIQ<br>YSRYTAFSLQDPFAPTQHLVLNLLDAWRVPLKVSAELLMSIRLPPKLKQNEVANVQPSSK<br>RARIEDVPPPTKKLTPELTPFVLFTGFEPVQVQQYIKKLYILGGEVAESAQKCTHLIASK<br>VTRTVKFLTAISVVKHIVTPEWLEECFRCQKFIDEQNYILRDAEAEVLFSFSLEESLKRA<br>HVSPLFKAKYFYITPGICPSLSTMKAIVECAGGKVLSKQPSFRKLMEHKQNSSLSEIILI<br>SCENDLHLCREYFARGIDVHNAEFVLTGVLTQTLDYESYKFN<br>>sp\|Q6ZW49\|PAXI1_HUMAN PAX-interacting protein 1 OS = Homo sapiens GN = PAXIP1 PE = 1 SV = 2<br>MSDQAPKVPEEMFREVKYYAVGDIDPQVIQLLKAGKAKEVSYNALASHIISEDGDNPEVG<br>EAREVFDLPVVKPSWVILSVQCGTLLPVNGFSPESCQIFFGITACLSQVSSEDRSALWAL |

TABLE VI.7-continued

Factors that promote canonical NHEJ

| Factor | Sequence |
|---|---|
|  | VTFYGGDCQLTLNKKCTHLIVPEPKGEKYECALKRASIKIVTPDWVLDCVSEKTKKDEAF YHPRLIIYEEEEEEEEEEEVENEEQDSQNEGSTDEKSSPASSQEGSPSGDQQFSPKSNT EKSKGELMFDDSSDSSPEKQERNLNWTPAEVPQLAAAKRRLPQGKEPGLINLCANVPPVP GNILPPEVRGNLMAAGQNLQSSERSEMIATWSPAVRTLRNITNNADIQQMNRPSNVAHIL QTLSAPTKNLEQQVNHSQQGHTNANAVLFSQVKVTPETHMLQQQQQAQQQQQQHPVLHLQ PQQIMQLQQQQQQQISQQPYPQQPPHPFSQQQQQQQQAHPHQFSQQQLQFPQQQLHPPQQ LHRPQQQLQPFQQQHALQQQFHQLQQHQLQQQQLAQLQQQHSLLQQQQQQQIQQQQLQRM HQQQQQQQMQSQTAPHLSQTSQALQHQVPPQQPPQQQQQQQPPPSPQQHQLFGHDPAVEI PEEGFLLGCVFAIADYPEQMSDKQLLATWKRITQAHGGTVDPTFTSRCTHLLCESQVSSA YAQAIRERKRCVTAHWLNTVLKKKKMVPPHRALHFPVAFPPGGKPCSQHIISVTGFVDSD RDDLKLMAYLAGAKYTGYLCRSNTVLICKEPTGLKYEKAKEWRIPCVNAQWLGDILLGNF EALRQIQYSRYTAFSLQDPFAPTQHLVLNLLDAWRVPLKVSAELLMSIRLPPKLKQNEVA NVQPSSKRARIEDVPPPTKKLTPELTPFVLFTGFEPVQVQQYIKKLYILGGEVAESAQKC THLIASKVTRTVKFLTAISVVKHIVTPEWLEECFRCQKFIDEQNYILRDAEAEVLFSFSL EESLKRAHVSPLFKAKYFYITPGICPSLSTMKAIVECAGGKVLSKQPSFRKLMEHKQNSS LSEIILISCENDLHLCREYFARGIDVHNAEFVLTGVLTQTLDYESYKFN |
| DNA polymerase | — |

More specifically, in some embodiments canonical NHEJ is down-regulated using NU7441 (which inhibits mTor and DNA Pk; see, e.g., Robert et al. (2015) GENOME MED. 7(1): 93), KU-0060648 (which also inhibits DNA Pk; see, e.g., Robert et al. (2015)), CC115 (which inhibits mTor and DNA Pk), NK314 (which inhibits a topoisomerase and DNA Pk), or an siRNA against 53BP1, or an agent of Table VI.8, or any combination thereof.

TABLE VI.8

Down-regulators of the canonical NHEJ pathway.

1. DNA Pk Inhibitors

| Compounds | Phase | Target |
|---|---|---|
| NU7441 |  | mTor and DNAPk |
| KU-0060648 |  | DNAPk |
| CC115 | Phase I | mTor and DNAPk |
| NK314 | Phase I | Topo and DNAPk |
| Wortmannin |  |  |
| LY294002 |  |  |
| NU 7026 |  |  |
| IC86621 |  |  |
| IC87102 |  |  |
| IC87361 |  |  |
| OK1035 |  |  |
| SU11752 |  |  |
| IC486241 |  |  |
| Vaillin |  |  | siRNAs

Accell Human PRKDC siRNA, sold by Dharmacon
PRKDC Silencer, sold by Life Technologies antibodies DNA-Pk antibody, sold by Biorbyt
Anti-DNA-PK (Ab-2) Mouse mAh (18-2), sold by EMD Millipore 2. LigIV

| Compounds | Reference(s) |
|---|---|
| SCR7 | See, e.g., Srivastava et al. (2012) CELL 151(7): 1474-1487; and Maruyama et al. (2015) NAT BIOTECHNOL. 33(5): 538-42. | siRNA

Commercially available from Dharmacon or Ambion 3. 53BP1 siRNAs

TP53BP1 Silencer, sold by Life Technologies
Accell Human TP53BP1 siRNA, sold by Dharmacon
CAGATATCAGCTTAGACAA TABLE VI.8-continued Down-regulators of the canonical NHEJ pathway.

antibodies

Anti-53BP1, clone BP13, sold by EMD Millipore
TP53BP1 monoclonal antibody (M01), clone 1B9, sold by Abnova Corporation
4. Rif1-interacting with 53BP1

| siRNA | Commercially available from Dharmacon or Ambion |
|---|---|

5. PTIP-interacting with 53BP1

| siRNA | Commercially available from Dharmacon or Ambion |
|---|---|

VI.4 Alternative Non-Homologous End-Joining (Alt-NHEJ)

Alt-NHEJ appears to encompass a variety of different DNA repair processes, including blut EJ, MMEJ, and SD-MMEJ (see FIG. 1). The common feature is that alt-NHEJ is independent from KU70/80 and Xrcc4/Ligase IV, and is associated with deletion at the repair junctions.

Alternative NHEJ has different subclasses, some of which have specific names like: MMEJ (microhomology mediated end-joining) and SDMMEJ (synthesis dependent micro homology mediated end-joining), and others that do not have specific names but are characterized by not having any microhomology at the break-point. In MMEJ, a limited amount of resection occurs and there is microhomology at the break site (typically 5-25 bp); MMEJ is one of the most abundant and characterized types of alt-NHEJ. In SDMMEJ, there is de novo synthesis by an accurate non-processive DNA polymerase that creates microhomology.

Alt-NHEJ is also mostly independent from DNAPk (a key participant in canonical NHEJ, as discussed above), and is instead dependent on the MRN complex (composed of MRE11, Rad50 and Nbs1) and CtIP, both of which participate in resection.

PARP1/2 have been postulated to have a role in protecting the ends and preventing the recruitment of KU, thereby promoting the alternative mechanisms and resection.

Alt-NHEJ is cell cycle independent; it can occur in G1, where limited resection is present and exposes the microhomology or, alternatively, a helicase might expose the microhomology (as occurs in MMEJ). Polymerases can fill in the gap and the XPF/ERCC1 complex (which is an endonuclease component also involved in NER and SSA) has a role in removing the DNA flap (the displaced strand that gets created). Finally, ligase I and a complex of XRCC1 and ligase III appear to have a role in the ligation of the ends. The latter two factors are also involved in NER, BER and SSBR.

Microhomology Mediated End-Joining (MMEJ)

In some embodiments, MMEJ is down-regulated in order to promote HDR. MMEJ is a type of alt-NHEJ. MMEJ typically acts where there has been a small degree of resection (e.g., 5-25 nt) at the break. It may be considered a backup pathway for situations where NHEJ fails.

The initial phase of MMEJ involves recognition of the break. PARP1/2, which binds to double strand breaks, can promote MMEJ. Next, the cell performs resection over a short distance from the break site. CtIP performs some resection in G1, which can also promote MMEJ. Next, the single stranded microhomology domains anneal with each other and LIG-3 performs DNA end ligation.

Synthesis Dependent Microhomology Mediated End-Joining (SSMMEJ)

In some embodiments, SDMMEJ is down-regulated in order to promote HDR. One of the best-reported proteins involved in SDMMEJ is Polymerase Theta (Pol Theta). Accordingly, in some embodiments, Pol Theta is inhibited in order to promote HDR.

In some embodiments, the methods herein involve down-regulating alt-NHEJ, e.g., MMEJ and/or SDMMEJ, in order to promote HDR. For instance, the methods may involve modulating, e.g., inhibiting, a component (e.g., exactly one component, or one or more components, e.g., two or three components) of the MMEJ pathway, e.g., a component of Table VI.9 or Table VI.1(J). More specifically, the methods may involve modulating, e.g., inhibiting, exactly one of, or one or more of a PARP, PARP1, PARP2, CtIP, and LIG-3. In another embodiment, the methods may involve modulating, e.g., inhibiting, Pol Theta. Up-regulation of HDR, in some embodiments, is achieved using siRNA directed against one or more of the components listed in Table VI.9 or Table VI.1(J). In some embodiments, an alt-NHEJ pathway is down regulated using an HDR-enhancing gRNA that targets a component of an alt-NHEJ pathway, e.g., one or more of the components listed in Table VI.9 or Table VI.1(J) (e.g., a PARP, PARP1, PARP2, CtIP, and LIG-3). In some embodiments, the HDR-enhancing gRNA is used in combination with an eiCas9 molecule. In some embodiments, the HDR-enhancing gRNA is used in combination with an eaCas9 molecule. In some embodiments, the HDR-enhancing gRNA is administered to the cell as a HDR-enhancing gRNA:Cas9 molecule complex.

In embodiments, one or more of HDR, alt-HR, anti-HR, NHEJ, SSA, SSBR, MMR, NER, and BER are not substantially down-regulated, e.g., the only DNA damage repair pathway to be substantially down-regulated is an alt-NHEJ pathway such as MMEJ pathway and/or SDMMEJ.

TABLE VI.9

Factors that promote alt-NHEJ

| a PARP | — |
|---|---|
| PARP1 | See Table VI.2 |
| PARP2 | See Table VI.2 |
| CtIP | See Table VI.2 |

TABLE VI.9-continued

Factors that promote alt-NHEJ

| | |
|---|---|
| LIG-3 | MSLAFKIFFPQTLRALSRKELCLFRKHHWRDVRQFSQWSETDLLHGHPLFLRRKPVLSFQGSHLRSRATY<br>LVFLPGLHVGLCSGPCEMAEQRFCVDYAKRGTAGCKKCKEKIVKGVCRIGKVVPNPFSESGGDMKEWYHI<br>KCMFEKLERARATTKKIEDLTELEGWEELEDNEKEQITQHIADLSSKAAGTPKKKAVVQAKLTTTGQVTS<br>PVKGASFVTSTNPRKFSGFSAKPNNSGEAPSSPTPKRSLSSSKCDPRHKDCLLREFRKLCAMVADNPSYN<br>TKTQIIQDFLRKGSAGDGFHGDVYLTVKLLLPGVIKTVYNLNDKQIVKLFSRIFNCNPDDMARDLEQGDV<br>SETIRVFFEQSKSFPPAAKSLLTIQEVDEFLLRLSKLTKEDEQQQALQDIASRCTANDLKCIIRLIKHDL<br>KMNSGAKHVLDALDPNAYEAFKASRNLQDVVERVLHNAQEVEKEPGQRRALSVQASLMTPVQPMLAEACK<br>SVEYAMKKCPNGMFSEIKYDGERVQVHKNGDHFSYFSRSLKPVLPHKVAHFKDYIPQAFPGGHSMILDSE<br>VLLIDNKTGKPLPFGTLGVHKKAAFQDANVCLFVFDCIYFNDVSLMDRPLCERRKFLHDNMVEIPNRIMF<br>SEMKRVTKALDLADMITRVIQEGLEGLVLKDVKGTYEPGKRHWLKVKKDYLNEGAMADTADLVVLGAFYG<br>QGSKGGMMSIFLMGCYDPGSQKWCTVTKCAGGHDDATLARLQNELDMVKISKDPSKIPSWLKVNKIYYPD<br>FIVPDPKKAAVWEITGAEFSKSEAHTADGISIRFPRCTRIRDDKDWKSATNLPQLKELYQLSKEKADFTV<br>VAGDEGSSTTGGSSEENKGPSGSAVSRKAPSKPSASTKKAEGKLSNSNSKDGNMQTAKPSAMKVGEKLAT<br>KSSPVKVGEKRKAADETLCQTKRRPASEQRGRTVPAGRR (LIG3 sequence 1)<br>MSLAFKIFFPQTLRALSRKELCLFRKHHWRDVRQFSQWSETDLLHGHPLFLRRKPVLSFQGSHLRSRATY<br>LVFLPGLHVGLCSGPCEMAEQRFCVDYAKRGTAGCKKCKEKIVKGVCRIGKVVPNPFSESGGDMKEWYHI<br>KCMFEKLERARATTKKIEDLTELEGWEELEDNEKEQITQHIADLSSKAAGTPKKKAVVQAKLTTTGQVTS<br>PVKGASFVTSTNPRKFSGFSAKPNNSGEAPSSPTPKRSLSSSKCDPRHKDCLLREFRKLCAMVADNPSYN<br>TKTQIIQDFLRKGSAGDGFHGDVYLTVKLLLPGVIKTVYNLNDKQIVKLFSRIFNCNPDDMARDLEQGDV<br>SETIRVFFEQSKSFPPAAKSLLTIQEVDEFLLRLSKLTKEDEQQQALQDIASRCTANDLKCIIRLIKHDL<br>KMNSGAKHVLDALDPNAYEAFKASRNLQDVVERVLHNAQEVEKEPGQRRALSVQASLMTPVQPMLAEACK<br>SVEYAMKKCPNGMFSEIKYDGERVQVHKNGDHFSYFSRSLKPVLPHKVAHFKDYIPQAFPGGHSMILDSE<br>VLLIDNKTGKPLPFGTLGVHKKAAFQDANVCLFVFDCIYFNDVSLMDRPLCERRKFLHDNMVEIPNRIMF<br>SEMKRVTKALDLADMITRVIQEGLEGLVLKDVKGTYEPGKRHWLKVKKDYLNEGAMADTADLVVLGAFYG<br>QGSKGGMMSIFLMGCYDPGSQKWCTVTKCAGGHDDATLARLQNELDMVKISKDPSKIPSWLKVNKIYYPD<br>FIVPDPKKAAVWEITGAEFSKSEAHTADGISIRFPRCTRIRDDKDWKSATNLPQLKELYQLSKEKADFTV<br>VAGDEGSSTTGGSSEENKGPSGSAVSRKAPSKPSASTKKAEGKLSNSNSKDGNMQTAKPSAMKVGEKLAT<br>KSSPVKVGEKRKAADETLCQTKVLLDIFTGVRLYLPPSTPDFSRLRRYFVAFDGDLVQEFDMTSATHVLG<br>SRDKNPAAQQVSPEWIWACIRKRRLVAPC (LIG3 sequence 2)<br>MVDVLLLFSLCLLFHISRPDLSHNRLSFIKASSMSHLQSLREVKLNNNELETIPNLGPVS<br>ANITLLSLAGNRIVEILPEHLKEFQSLETLDLSSNNISELQTAFFPALQLKYLYLNSNRVT<br>SMEPGYFDNLANTLLVLKLNRNRISAIPPKMFKLPQLQHLELNRNKIKNVDGLTFQGLGA<br>LKSLKMQRNGVTKLMDGAFWGLSNMEILQLDHNNLTEITKGWLYGLLMLQELHLSQNAIN<br>RISPDAWEFCQKLSELDLTFNHLSRLDDSSFLGLSLLNTLHIGNNRVSYIADCAFRGLSS<br>LKTLDLKNNEISWTIEDMNGAFSGLDKLRRLILQGNRIRSITKKAFTGLDALEHLDLSDN<br>AIMSLQGNAFSQMKKLQQLHLNTSSLLCDCQLKWLPQWVAENNFQSFVNASCAHPQLLKG<br>RSIFAVSPDGFVCDDFPKPQITVQPETQSAIKGSNLSFICSAASSSDSPMTFAWKKDNEL<br>LHDAEMENYAHLRAQGGEVMEYTTILRLREVEFASEGKYQCVISNHFGSSYSVKAKLTVN<br>MLPSFTKTPMDLTIRAGAMARLECAAVGHPAPQIAWQKDGGTDFPAARERRMHVMPEDDV<br>FFIVDVKIEDIGVYSCTAQNSAGSISANATLTVLETPSFLRPLLDRTVTKGETAVLQCIA<br>GGSPPPKLNWTKDDSPLVVTERHFFAAGNQLLIIVDSDVSDAGKYTCEMSNTLGTERGNV<br>RLSVIPTPTCDSPQMTAPSLDDDGWATVGVVIIAVVCCVVGTSLVWVVIIYHTRRRNEDC<br>SITNTDETNLPADIPSYLSSQGTLADRQDGYVSSESGSHHQFVTSSGAGFFLPQHDSSGT<br>CHIDNSSEADVEAATDLFLCPFLGSTGPMYLKGNVYGSDPFETYHTGCSPDPRTVLMDHY<br>EPSYIKKKECYPCSHPSEESCERSFSNISWPSHVRKLLNTSYSHNEGPGMKNLCLNKSSL<br>DFSANPEPASVASSNSFMGTFGKALRRPHLDAYSSFGQPSDCQPRAFYLKAHSSPDLDSG<br>SEEDGKERTDFQEENHICTFKQTLENYRTPNFQSYDLDT (LIG3 sequence 3) |
| MRE11 | See Table VI.2 |
| Rad50 | See Table VI.2 |
| Nbs1 | See Table VI.2 |
| CtIP | See Table VI.2 |
| XPF | MESGQPARRIAMAPLLEYERQLVLELLDTDGLVVCARGLGADRLLYHFLQLHCHPACLVL<br>VLNTQPAEEEYFINQLKIEGVEHLPRRVTNEITSNSRYEVYTQGGVIFATSRILVVDFLT<br>DRIPSDLITGILVYRAHRIIESCQEAFILRLFRQKNKRGFIKAPTDNAVAFDTGFCHVER<br>VMRNLFVRKLYLWPRFHVAVNSFLEQHKPEVVEIHVSMTPTMLAIQTAILDILNACLKEL<br>KCHNPSLEVEDLSLENAIGKPFDKTIRHYLDPLWHQLGAKTKSLVQDLKILRTLLQYLSQ<br>YDCVTFLNLLESLRATEKAFGQNSGWLFLDSSTSMFINARARVYHLPDAKMSKKEKISEK<br>MEIKEGEETKKELVLESNPKWEALTEVLKEIEAENKESEALGGPGQVLICASDDRTCSQL<br>RDYITLGAEAFLLRLYRKTFEKDSKAEEVWMKFRKEDSSKRIRKSHRRPKDPQNKERAST<br>KERTLKKKKRKLTLTQMVGKPEELEEEGDVEEGYRREISSSPESCPEEIKHEEFDVNLSS<br>DAAFGILKEPLTIIHPLLGCSDPYALTRVLHEVEPRYVVLYDAELTFVRQLEIYRASRPG<br>KPLRVYFLIYGGSTEEQRYLTALRKEKEAFEKLIREKASMVVPEEREGRDETNLDLVRGT<br>ASADVSTDTRKAGGQEQNGTQQSIVVDMREFRSELPSLIHRRGIDIEPVTLEVGDYILTP<br>EMCVERKSISDLIGSLNNGRLYSQCISMSRYYKRPVLLIEFDPSKPFSLTSRGALFQEIS<br>SNDISSKLTLLTLHFPRLRILWCPSPHATAELFEELKQSKPQPDAATALAITADSETLPE<br>SEKYNPGPQDFLLKMPGVNAKNCRSLMHHVKNIAELAALSQDELTSILGNAANAKQLYDF<br>IHTSFAEVVSKGKGKK (XPF CCDS 32390.1) |
| ERCC1 | >sp|P07992|ERCC1_HUMAN DNA excision repair protein ERCC-1<br>OS = Homo sapiens GN = ERCC1 PE = 1 SV = 1<br>MDPGKDKEGVPQPSGPPARKKFVIPLDEDEVPPGVAKPLFRSTQSLPTVDTSAQAAPQTY<br>AEYAISQPLEGAGATCPTGSEPLAGETPNQALKPGAKSNSIIVSPRQRGNPVLKFVRNVP |

TABLE VI.9-continued

Factors that promote alt-NHEJ

|  |  |
|---|---|
|  | WEFGDVIPDYVLGQSTCALFLSLRYHNLHPDYIHGRLQSLGKNFALRVLLVQVDVKDPQQ<br>ALKELAKMCILADCTLILAWSPEEAGRYLETYKAYEQKPADLLMEKLEQDFVSRVTECLT<br>TVKSVNKTDSQTLLTTFGSLEQLIAASREDLALCPGLGPQKARRLFDVLHEPFLKVP<br>>sp\|P07992-2\|ERCC1_HUMAN Isoform 2 of DNA excision repair protein<br>ERCC-1 OS = Homo sapiens GN = ERCC1<br>MDPGKDKEGVPQPSGPPARKKFVIPLDEDEVPPGVAKPLFRSTQSLPTVDTSAQAAPQTY<br>AEYAISQPLEGAGATCPTGSEPLAGETPNQALKPGAKSNSIIVSPRQRGNPVLKFVRNVP<br>WEFGDVIPDYVLGQSTCALFLSLRYHNLHPDYIHGRLQSLGKNFALRVLLVQVDVKDPQQ<br>ALKELAKMCILADCTLILAWSPEEAGRYLETYKAYEQKPADLLMEKLEQDFVSRSLEQLI<br>AASREDLALCPGLGPQKARRLFDVLHEPFLKVP<br>>sp\|P07992-3\|ERCC1_HUMAN Isoform 3 of DNA excision repair protein<br>ERCC-1 OS = Homo sapiens GN = ERCC1<br>MDPGKDKEGVPQPSGPPARKKFVIPLDEDEVPPGVAKPLFRSTQSLPTVDTSAQAAPQTY<br>AEYAISQPLEGAGATCPTGSEPLAGETPNQALKPGAKSNSIIVSPRQRGNPVLKFVRNVP<br>WEFGDVIPDYVLGQSTCALFLSLRYHNLHPDYIHGRLQSLGKNFALRVLLVQVDVKDPQQ<br>ALKELAKMCILADCTLILAWSPEEAGRYLETYKAYEQKPADLLMEKLEQDFVSRVTECLT<br>TVKSVNKTDSQTLLTTFGSLEQLIAASREDLALCPGLGPQKVRALGKNPRSWGKERAPNK<br>HNLRPQSFKVKKEPKTRHSGFRL<br>>sp\|P07992-4\|ERCC1_HUMAN Isoform 4 of DNA excision repair protein<br>ERCC-1 OS = Homo sapiens GN = ERCC1<br>MDPGKDKEGVPQPSGPPARKKFVIPLDEDEVPPGVRGNPVLKFVRNVPWEFGDVIPDYVL<br>GQSTCALFLSLRYHNLHPDYIHGRLQSLGKNFALRVLLVQVDVKDPQQALKELAKMCILA<br>DCTLILAWSPEEAGRYLETYKAYEQKPADLLMEKLEQDFVSRVTECLTTVKSVNKTDSQT<br>LLTTFGSLEQLIAASREDLALCPGLGPQKARRLFDVLHEPFLKVP |
| Ligase-1 (LIG1) | MQRSIMSFFHPKKEGKAKKPEKEASNSSRETEPPPKAALKEWNGVVSESDSPVKRPGRKAARVLGSEGEE<br>EDEALSPAKGQKPALDCSQVSPPRPATSPENNASLSDTSPMDSSPSGIPKRRTARKQLPKRTIQEVLEEQ<br>SEDEDREAKRKKEEEEETPKESLTEAEVATEKEGEDGDQPTTPPKPLKTSKAETPTESVSEPEVATKQE<br>LQEEEEQTKPPRRAPKTLSSFFTPRKPAVKKEVKEEEPGAPGKEGAAEGPLDPSGYNPAKNNYHPVEDAC<br>WKPGQKVPYLAVARTFEKIEEVSARLRMVETLSNLLRSVVALSPPDLLPVLYLSLNHLGPPQQGLELGVG<br>DGVLLKAVAQATGRQLESVRAEAAEKGDVGLVAENSRSTQRLMLPPPPLTASGVFSKFRDIARLTGSAST<br>AKKIDIIKGLFVACRHSEARFIARSLSGRLRLGLAEQSVLAALSQAVSLTPPGQEFPPAMVDAGKGKTAE<br>ARKTWLEEQGMILKQTFCEVPDLDRIIPVLLEHGLERLPEHCKLSPGIPLKPMLAHPTRGISEVLKRFEE<br>AAFTCEYKYDGQRAQIHALEGGEVKIFSRNQEDNTGKYPDIISRIPKIKLPSVTSFILDTEAVAWDREKK<br>QIQPFQVLTTRKRKEVDASEIQVQVCLYAFDLIYLNGESLVREPLSRRRQLLRENFVETEGEFVFATSLD<br>TKDIEQIAEFLEQSVKDSCEGLMVKTLDVDATYEIAKRSHNWLKLKKDYLDGVGDTLDLVVIGAYLGRGK<br>RAGRYGGFLLASYDEDSEELQAICKLGTGFSDEELEEHHQSLKALVLPSPRPYVRIDGAVIPDHWLDPSA<br>VWEVKCADLSLSPIYPAARGLVDSDKGISLRFPRFIRVREDKQPEQATTSAQVACLYRKQSQIQNQQGED<br>SGSDPEDTY (LIG1 sequence 1)<br>MQRSIMAALKEWNGVVSESDSPVKRPGRKAARVLGSEGEEEDEALSPAKGQKPALDCSQVSPPRPATSPE<br>NNASLSDTSPMDSSPSGIPKRRTARKQLPKRTIQEVLEEQSEDEDREAKRKKEEEEETPKESLTEAEVAT<br>EKEGEDGDQPTTPPKPLKTSKAETPTESVSEPEVATKQELQEEEEQTKPPRRAPKTLSSFFTPRKPAVKK<br>EVKEEEPGAPGKEGAAEGPLDPSGYNPAKNNYHPVEDACWKPGQKVPYLAVARTFEKIEEVSARLRMVET<br>LSNLLRSVVALSPPDLLPVLYLSLNHLGPPQQGLELGVGDGVLLKAVAQATGRQLESVRAEAAEKGDVGL<br>VAENSRSTQRLMLPPPPLTASGVFSKFRDIARLTGSASTAKKIDIIKGLFVACRHSEARFIARSLSGRLR<br>LGLAEQSVLAALSQAVSLTPPGQEFPPAMVDAGKGKTAEARKTWLEEQGMILKQTFCEVPDLDRIIPVLL<br>EHGLERLPEHCKLSPGIPLKPMLAHPTRGISEVLKRFEEAAFTCEYKYDGQRAQIHALEGGEVKIFSRNQ<br>EDNTGKYPDIISRIPKIKLPSVTSFILDTEAVAWDREKKQIQPFQVLTTRKRKEVDASEIQVQVCLYAFD<br>LIYLNGESLVREPLSRRRQLLRENFVETEGEFVFATSLDTKDIEQIAEFLEQSVKDSCEGLMVKTLDVDA<br>TYEIAKRSHNWLKLKKDYLDGVGDILDLVVIGAYLGRGKRAGRYGGFLLASYDEDSEELQAICKLGTGFS<br>DEELEEHHQSLKALVLPSPRPYVRIDGAVIPDHWLDPSAVWEVKCADLSLSPIYPAARGLVDSDKGISLR<br>FPRFIRVREDKQPEQATTSAQVACLYRKQSQIQNQQGEDSGSDPEDTY (LIG1 sequence 2)<br>MQRSIMSFFHPKKEGKAKKPEKEASNSSRETEPPPKAALKEWNGVVSESDSPVKRPGRKAARVLGSEGEE<br>EDEALSPAKGQKPALDCSQVSPPRPATSPENNASLSDTSPMDSSPSGIPKRRTEAETPTESVSEPEVATK<br>QELQEEEEQTKPPRRAPKTLSSFFTPRKPAVKKEVKEEEPGAPGKEGAAEGPLDPSGYNPAKNNYHPVED<br>ACWKPGQKVPYLAVARTFEKIEEVSARLRMVETLSNLLRSVVALSPPDLLPVLYLSLNHLGPPQQGLELG<br>VGDGVLLKAVAQATGRQLESVRAEAAEKGDVGLVAENSRSTQRLMLPPPPLTASGVFSKFRDIARLTGSA<br>STAKKIDIIKGLFVACRHSEARFIARSLSGRLRLGLAEQSVLAALSQAVSLTPPGQEFPPAMVDAGKGKT<br>AEARKTWLEEQGMILKQTFCEVPDLDRIIPVLLEHGLERLPEHCKLSPGIPLKPMLAHPTRGISEVLKRF<br>EEAAFTCEYKYDGQRAQIHALEGGEVKIFSRNQEDNTGKYPDIISRIPKIKLPSVTSFILDTEAVAWDRE<br>KKQIQPFQVLTTRKRKEVDASEIQVQVCLYAFDLIYLNGESLVREPLSRRRQLLRENFVETEGEFVFATS<br>LDTKDIEQIAEFLEQSVKDSCEGLMVKTLDVDATYEIAKRSHNWLKLKKDYLDGVGDTLDLVVIGAYLGR<br>GKRAGRYGGFLLASYDEDSEELQAICKLGTGFSDEELEEHHQSLKALVLPSPRPYVRIDGAVIPDHWLDP<br>SAVWEVKCADLSLSPIYPAARGLVDSDKGISLRFPRFIRVREDKQPEQATTSAQVACLYRKQSQIQNQQG<br>EDSGSDPEDTY (LIG1 sequence 3) |
| Pol Theta | >sp\|O75417\|DPOLQ_HUMAN DNA polymerase theta OS = Homo sapiens<br>GN = POLQ PE = 1 SV = 2<br>MNLLRRSGKRRRSESGSDSFSGSGGDSSASPQFLSGSVLSPPPGLGRCLKAAAAGECKPT<br>VPDYERDKLLLANWGLPKAVLEKYHSFGVKKMFEWQAECLLLGQVLEGKNLVYSAPTSAG<br>KTLVAELLILKRVLEMRKKALFILPFVSVAKEKKYYLQSLFQEVGIKVDGYMGSTSPSRH<br>FSSLDIAVCTIERANGLINRLIEENKMDLLGMVVVDELHMLGDSHRGYLLELLLTKICYI<br>TRKSASCQADLASSLSNAVQIVGMSATLPNLELVASWLNAELYHTDFRPVPLLESVKVGN<br>SIYDSSMKLVREFEPMLQVKGDEDHVVSLCYETICDNHSVLLFCPSKKWCEKLADIIARE<br>FYNLHHQAEGLVKPSECPPVILEQKELLEVMDQLRRLPSGLDSVLQKTVPWGVAFHHAGL<br>TFEERDIIEGAFRQGLIRVLAATSTLSSGVNLPARRVIIRTPIFGGRPLDILTYKQMVGR<br>AGRKGVDTVGESILICKNSEKSKGIALLQGSLKPVRSCLQRREGEEVTGSMIRAILEIIV<br>GGVASTSQDMHTYAACTFLAASMKEGKGQIQRNQESVQLGAIEACVMWLLENEFIQSTEA |

TABLE VI.9-continued

Factors that promote alt-NHEJ

| | |
|---|---|
| | SDGTEGKVYHPTHLGSAILSSSLSPADTLDIFADLQRAMKGFVLENDLHILYLVIPMFED<br>WITIDWYRFFCLWEKLPTSMKRVAELVGVEEGFLARCVKGKVVARTEQHRQMAIHKRFF<br>TSLVLLDLISEVPLREINQKYGCNRGQIQSLQQSAAVYAGMITVFSNRLGWHNMELLLSQ<br>FQKRLIFGIQRELCDLVRVSLLNAQRARVLYASGFHTVADLARANIVEVEVILKNAVPFK<br>SARKAVDEEEEAVEERRNMRTIWVTGRKGLTEREAAALIVEEARMILQQDLVEMGVQWNP<br>CALLHSSICSLTHSESEVKEHTFISQTKSSYKKLISKNKSNTIFSDSYIKHSPNIVQDLN<br>KSREHTSSFNCNFQNGNQEHQICSIFRARKRASLDINKEKPGASQNEGKISDKKVVQTFS<br>QKIKKAPLNFNSEKMSRSFRSWKRRKHLKRSRDSSPLKDSGACRIHLQGQILSNPSLCED<br>PFILDEKKTEFRNSGPFAKNVSLSGKEKDNKTSFPLQIKQNCSWNITLINDNFVEHIVIG<br>SQSKNVICQATSVVSEKGRGVAVEAEKINEVLIQNGSKNQNVYMKHHDIHPINQYLRKQS<br>HEQTSTITKQKNIIERQMPCEAVSSYINRDSNVTINCERIKLNTEENKPSHFQALGDDIS<br>RIVIPSEVLPSAGAFSKSEGQHENFLNISRLQEKTGTYTINKTKNNHVSDLGLVLCDFED<br>SFYLDTQSEKIIQQMATENAKLGAKDINLAAGIMQKSLVQQNSMNSFQKECHIPFPAEQH<br>PLGATKIDHLDLKTVGIMKQSSDSHGVDILTPESPIFHSPILLEENGLFLKKNEVSVIDS<br>QLNSFLQGYQTQETVKPVILLIPQKRIPTGVEGECLPVPETSLNMSDSLLFDSFSDDYLV<br>KEQLPDMQMKEPLPSEVISNHFSDSLCLQEDLIKKSNVNENQDTHQQLICSNDESIIFSE<br>MDSVQMVEALDNVDIFPVQEKNHTVVSPRALELSDPVLDEHHQGDQDGGDQDERAEKSKL<br>TGIRQNHSFIWSGASFDLSPGLQRILDKVSSPLENEKLKSMTINFSSLNRKNTELNEEQE<br>VISNLETKQVQGISFSSNNEVKSKIEMLENNANHDETSSLLPRKESNIVDDNGLIPPIPI<br>PTSASKLIFPGILETPVNPWKINNVLQPGESYLFGSPSDIKNHDLSPGSRNGFKDNSPIS<br>DISFSLQLSQDGLQLTPASSSSESLSIIDVASDQNLFQTFIKEWRCKKRFSISLACEKIR<br>SLISSSKTATIGSRFKQASSPQEIPIRDDGFPIKGCDDILVVGLAVCWGGRDAYYFSLQKE<br>QKHSEISASLVPPSLDPSLILKDRMWYLQSCLRKESDKECSVVIYDFIQSYKILLLSCGI<br>SLEQSYEDPKVACWLLDPDSQEPTLHSIVISFLPHELPLLEGMETSQGIQSLGLNAGSEH<br>SGRYRASVESILIFNSMNQLNSLLQKENLQDVFRKVEMPSQYCLALLELNGIGFSTAECE<br>SQKHIMQAKLDAIETQAYQLAGHSFSFISSDDIAEVLFLELKLPPNREMKNQGSKKILGS<br>TRRGIDNGRKLRLGRQFSTSKDVLNKLKALHPLPGLILEWRRITNAITKVVFPLQREKCL<br>NPFLGMERIYPVSQSHTATGRITFTEPNIQNVPRDFEIKMPTLVGESPPSQAVGKGLLPM<br>GRGKYKKGFSVNPRCQAQMEERAADRGMPFSISMRHAFVPFPGGSILAADYSQLELRILA<br>HLSHDRRLIQVLNIGADVFRSIAAEWKMIEPESVGDDLRQQAKQICYGIIYGMGAKSLGE<br>QMGIKENDAACYIDSFKSRYTGINQFMTETVKNCKRDGFVQTILGRRRYLPGIKDNNPYR<br>KAHAERQAINTIVQGSAADIVKIATVNIQKQLETFHSTFKSHGHREGMLQSDQTGLSRKR<br>KLQGMFCPIRGGFFILQLHDELLYEVAEEDVVQVAQIVKNEMESAVKLSVKLKVKVKIGA<br>SWGELKDFDV<br>>sp\|O75417-2\|DPOLQ_HUMAN Isoform 2 of DNA polymerase theta<br>OS = Homo sapiens GN = POLQ<br>MNSFLSFPISLCSARKAVDEEEEAVEERRNMRTIWVTGRKGLTEREAAALIVEEARMILQ<br>QDLVEMGVQWNPCALLHSSICSLTHSESEVKEHTFISQTKSSYKKLISKNKSNTIFSDSY<br>IKHSPNIVQDLNKSREHTSSFNCNFQNGNQEHQICSIFRARKRASLDINKEKPGASQNEG<br>KTSDKKVVQTFSQKIKKAPLNFNSEKMSRSFRSWKRRKHLKRSRDSSPLKDSGACRIHLQ<br>GQILSNPSLCEDPFILDEKKTEFRNSGPFAKNVSLSGKEKDNKTSFPLQIKQNCSWNITL<br>INDNFVEHIVIGSQSKNVICQATSVVSEKGRGVAVEAEKINEVLIQNGSKNQNVYMKHHD<br>IHPINQYLRKQSHEQTSTITKQKNIIERQMPCEAVSSYINRDSNVTINCERIKLNTEENK<br>PSHFQALGDDISRIVIPSEVLPSAGAFSKSEGQHENFLNISRLQEKTGTYTINKTKNNHV<br>SDLGLVLCDFEDSFYLDTQSEKIIQQMATENAKLGAKDINLAAGIMQKSLVQQNSMNSFQ<br>KECHIPFPAEQHPLGATKIDHLDLKTVGIMKQSSDSHGVDILTPESPIFHSPILLEENGL<br>FLKKNEVSVTDSQLNSFLQGYQTQETVKPVILLIPQKRTPTGVEGECLPVPETSLNMSDS<br>LLFDSFSDDYLVKEQLPDMQMKEPLPSEVTSNHFSDSLCLQEDLIKKSNVNENQDTHQQL<br>TCSNDESIIFSEMDSVQMVEALDNVDIFPVQEKNHTVVSPRALELSDPVLDEHHQGDQDG<br>GDQDERAEKSKLTGTRQNHSFIWSGASFDLSPGLQRILDKVSSPLENEKLKSMTINFSSL<br>NRKNTELNEEQEVISNLETKQVQGISFSSNNEVKSKIEMLENNANHDETSSLLPRKESNI<br>VDDNGLIPPTPIPTSASKLTFPGILETPVNPWKTNNVLQPGESYLFGSPSDIKNHDLSPG<br>SRNGFKDNSPISDTSFSLQLSQDGLQLTPASSSSESLSIIDVASDQNLFQTFIKEWRCKK<br>RFSISLACEKIRSLTSSKTATIGSRFKQASSPQEIPIRDDGFPIKGCDDTLVVGLAVCWG<br>GRDAYYFSLQKEQKHSEISASLVPPSLDPSLTLKDRMWYLQSCLRKESDKECSVVIYDFI<br>QSYKILLLSCGISLEQSYEDPKVACWLLDPDSQEPTLHSIVTSFLPHELPLLEGMETSQG<br>IQSLGLNAGSEHSGRYRASVESILIFNSMNQLNSLLQKENLQDVFRKVEMPSQYCLALLE<br>LNGIGFSTAECESQKHIMQAKLDAIETQAYQLAGHSFSFTSSDDIAEVLFLELKLPPNRE<br>MKNQGSKKTLGSTRRGIDNGRKLRLGRQFSTSKDVLNKLKALHPLPGLILEWRRITNAIT<br>KVVFPLQREKCLNPFLGMERTYPVSQSHTATGRITFTEPNIQNVPRDFEIKMPTLVGESP<br>PSQAVGKGLLPMGRGKYKKGFSVNPRCQAQMEERAADRGMPFSISMRHAFVPFPGGSILA<br>ADYSQLELRILAHLSHDRRLIQVLNTGADVFRSIAAEWKMIEPESVGDDLRQQAKQICYG<br>ITYGMGAKSLGEQMGIKENDAACYIDSFKSRYTGINQFMTETVKNCKRDGFVQTILGRRR<br>YLPGIKDNNPYRKAHAERQAINTIVQGSAADIVKIATVNIQKQLETFHSTFKSHGHREGM<br>LQSDQTGLSRKRKLQGMFCPIRGGFFILQLHDELLYEVAEEDVVQVAQIVKNEMESAVKL<br>SVKLKVKVKIGASWGELKDFDV |
| MRN complex | — |
| XRCC1 | >sp\|P18887\|XRCC1_HUMAN DNA repair protein XRCC1<br>OS = Homo sapiens GN = XRCC1 PE = 1 SV = 2<br>MPEIRLRHVVSCSSQDSTHCAENLLKADTYRKWRAAKAGEKTISVVLQLEKEEQIHSVDI<br>GNDGSAFVEVLVGSSAGGAGEQDYEVLLVTSSFMSPSESRSGSNPNRVRMFGPDKLVRAA<br>AEKRWDRVKIVCSQPYSKDSPFGLSFVRFHSPPDKDEAEAPSQKVTVTKLGQFRVKEEDE<br>SANSLRPGALFFSRINKTSPVTASDPAGPSYAAATLQASSAASSASPVSRAIGSTSKPQE<br>SPKGKRKLDLNQEEKKTPSKPPAQLSPVPKRPKLPAPTRTPATAPVPARAQGAVTGKPR<br>GEGTEPRRPRAGPEELGKILQGVVVVLSGFQNPFRSELRDKALELGAKYRPDWTRDSTHL<br>ICAFANTPKYSQVLGLGGRIVRKEWVLDCHRMRRRLPSRRYLMAGPGSSSEEDEASHSGG |

TABLE VI.9-continued

Factors that promote alt-NHEJ

SGDEAPKLPQKQPQTKTKPTQAAGPSSPQKPPTPEETKAASPVLQEDIDIEGVQSEGQDN
GAEDSGDTEDELRRVAEQKEHRLPPGQEENGEDPYAGSTDENTDSEEHQEPPDLPVPELP
DFFQGKHFFLYGEFPGDERRKLIRYVTAFNGELEDNMSDRVQFVITAQEWDPSFEEALMD
NPSLAFVRPRWIYSCNEKQKLLPHQLYGVVPQA

Inhibitors of some of the proteins of Table VI.9 above are listed elsewhere in this specification. In some embodiments alt-NHEJ is down-regulated using an agent of Table VI.10, or any combination thereof.

TABLE VI.10

Down-regulators of the alt-NHEJ pathway.

L67 (inhibits LIG1 and LIG3; reviewed in Tomkinson et al. (2013) TRANSL. CANCER RES. 2(3): 1213.)
L82 (inhibits LIG1; reviewed in Tomkinson et al.)
L189 (inhibits LIG1, LIG3, and LIG4; reviewed in Tomkinson et al.)
SCR7 (inhibits LIG3 and LIG4; reviewed in Tomkinson et al.)

VI.5 Single Strand Annealing (SSA)

Single strand annealing (SSA) is a that repairs double-stranded breaks. SSA is believed to be a sub-branch of HDR. As with HDR, a cell typically uses SSA when there has been significant resection at the break. Thus, SSA is characterized by having longer length of resection (longer than Alt-NHEJ) and a longer stretch of homology at the DSB site (>30 bp). SSA competes with HR in S phase.

As in other HDR pathways, resection leads to the formation of single stranded DNA regions. These regions are bound and stabilized by RPA, a heterotrimer comprising RPA1, RPA2, and RPA3. Whereas in the other HDR pathways, RAD51 binds the single stranded region, in the SSA pathway, RAD52 is involved. RAD52 promotes annealing of the two single stranded DNA segments at repetitive regions. Next, XPF/ERCC1 removes DNA flaps to make the DNA more suitable for ligation.

In some embodiments, other HDR pathways are promoted by down-regulating the SSA pathway. For example, in some embodiments, a Cas9 molecule and a gRNA can induce a DSB in a desired location during G2 or another phase of the cell cycle. This DSB can be formed using, e.g., one Cas9 molecule with the ability to produce DSBs, or two nickases. The DSB may undergo some resection, and/or may be created by a pair of staggered nicks that leaves some single stranded DNA at the break. In S/G2, an SSA down-regulator can increase the likelihood that a resected DSB is repaired by HDR. A template nucleic acid can be added to the cell, so that the HDR machinery repairs the DSB using the template nucleic acid.

Accordingly, in some embodiments, the methods herein involve down-regulating SSA in order to promote HDR pathways, such as HR and/or alt-HR. For instance, the methods may involve modulating, e.g., inhibiting, a component (e.g., exactly one component, or one or more components, e.g., two or three components) of the SSA pathway, e.g., a component of Table VI.1(E) or Table VI.11. More specifically, the methods may involve modulating, e.g., inhibiting, exactly one of, or one or more of RPA, RPA1, RPA2, RPA3, RAD52, XPF/ERCC1, and a ligase. Up-regulation of HDR, in some embodiments, is achieved using siRNA directed against one or more of the components listed in Table VI.1(E) or Table VI.11. In some embodiments, a SSA pathway is down regulated using an HDR-enhancing gRNA that targets a component of a SSA pathway, e.g., one or more of the components listed in Table VI.1(E) or Table VI.11 (e.g., RPA, RPA1, RPA2, RPA3, RAD52, XPF/ERCC1, and a ligase). In some embodiments, the HDR-enhancing gRNA is used in combination with an eiCas9 molecule. In some embodiments, the HDR-enhancing gRNA is used in combination with an eaCas9 molecule. In some embodiments, the HDR-enhancing gRNA is administered to the cell as a HDR-enhancing gRNA:Cas9 molecule complex.

In some embodiments, one or more of HR, alt-HR, anti-HR, NHEJ, MMEJ, SSBR, MMR, NER, and BER are not substantially down-regulated, e.g., the only DNA damage repair pathway to be substantially down-regulated is the SSA pathway.

TABLE VI.11

Factors that promote SSA

RPA —
RPA1 >sp|O95602|RPA1_HUMAN DNA-directed RNA polymerase I subunit RPA1
OS = Homo sapiens GN = POLR1A PE = 1 SV = 2
MLISKNMPWRRLQGISFGMYSAEELKKLSVKSITNPRYLDSLGNPSANGLYDLALGPADS
KEVCSTCVQDFSNCSGHLGHIELPLTVYNPLLFDKLYLLLRGSCLNCHMLTCPRAVIHLL
LCQLRVLEVGALQAVYELERILNRFLEENPDPSASEIREELEQYTTEIVQNNLLGSQGAH
VKNVCESKSKLIALFWKAHMNAKRCPHCKTGRSVVRKEHNSKLTITFPAMVHRTAGQKDS
EPLGIEEAQIGKRGYLTPTSAREHLSALWKNEGFFLNYLFSGMDDDGMESRFNPSVFFLD
FLVVPPSRYRPVSRLGDQMFTNGQTVNLQAVMKDVVLIRKLLALMAQEQKLPEEVATPTT
DEEKDSLIAIDRSFLSTLPGQSLIDKLYNIWIRLQSHVNIVFDSEMDKLMMDKYPGIRQI
LEKKEGLFRKHMMGKRVDYAARSVICPDMYINTNEIGIPMVFATKLTYPQPVTPWNVQEL
RQAVINGPNVHPGASMVINEDGSRTALSAVDMTQREAVAKQLLTPATGAPKPQGTKIVCR
HVKNGDILLLNRQPTLHRPSIQAHRARILPEEKVLRLHYANCKAYNADFDGDEMNAHFPQ
SELGRAEAYVLACTDQQYLVPKDGQPLAGLIQDHMVSGASMTTRGCFFTREHYMELVYRG
LTDKVGRVKLLSPSILKPFPLWTGKQVVSTLLINIIPEDHIPLNLSGKAKITGKAWVKET
PRSVPGFNPDSMCESQVIIREGELLCGVLDKAHYGSSAYGLVHCCYEIYGGETSGKVLTC TABLE VI.11-continued Factors that promote SSA

| | |
|---|---|
| | LARLFTAYLQLYRGFTLGVEDILVKPKADVKRQRIIEESTHCGPQAVRAALNLPEAASYD<br>EVRGKWQDAHLGKDQRDFNMIDLKFKEEVNHYSNEINKACMPFGLHRQFPENSLQMMVQS<br>GAKGSTVNTMQISCLLGQIELEGRRPPLMASGKSLPCFEPYEFTPRAGGFVTGRFLTGIK<br>PPEFFFHCMAGREGLVDTAVKTSRSGYLQRCIIKHLEGLVVQYDLTVRDSDGSVVQFLYG<br>EDGLDIPKTQFLQPKQFPFLASNYEVIMKSQHLHEVLSRADPKKALHHFRAIKKWQSKHP<br>NTLLRRGAFLSYSQKIQEAVKALKLESENRNGRSPGTQEMLRMWYELDEESRRKYQKKAA<br>ACPDPSLSVWRPDIYFASVSETFETKVDDYSQEWAAQTEKSYEKSELSLDRLRTLLQLKW<br>QRSLCEPGEAVGLLAAQSIGEPSTQMTLNTFHFAGRGEMNVTLGIPRLREILMVASANIK<br>TPMMSVPVLNTKKALKRVKSLKKQLTRVCLGEVLQKIDVQESFCMEEKQNKFQVYQLRFQ<br>FLPHAYYQQEKCLRPEDILRFMETRFFKLLMESIKKKNNKASAFRNVNTRRATQRDLDNA<br>GELGRSRGEQEGDEEEEGHIVDAEAEEGDADASDAKRKEKQEEEVDYESEEEEEREGEEN<br>DDEDMQEERNPHREGARKTQEQDEEVGLGTEEDPSLPALLTQPRKPTHSQEPQGPEAMER<br>RVQAVREIHPFIDDYQYDTEESLWCQVTVKLPLMKINFDMSSLVVSLAHGAVIYATKGIT<br>RCLLNETTNNKNEKELVLNTEGINLPELFKYAEVLDLRRLYSNDIHAIANTYGIEAALRV<br>IEKEIKDVFAVYGIAVDPRHLSLVADYMCFEGVYKPLNRFGIRSNSSPLQQMTFETSFQF<br>LKQATMLGSHDELRSPSACLVVGKVVRGGTGLFELKQPLR |
| RPA2 | >sp\|P15927\|RFA2_HUMAN Replication protein A 32 kDa subunit<br>OS = Homo sapiens GN = RPA2 PE = 1 SV = 1<br>MWNSGFESYGSSSYGGAGGYTQSPGGFGSPAPSQAEKKSRARAQHIVPCTISQLLSATLV<br>DEVFRIGNVEISQVTIVGIIRHAEKAPTNIVYKIDDMTAAPMDVRQWVDTDDTSSENTVV<br>PPETYVKVAGHLRSFQNKKSLVAFKIMPLEDMNEFTTHILEVINAHMVLSKANSQPSAGR<br>APISNPGMSEAGNFGGNSFMPANGLTVAQNQVLNLIKACPRPEGLNFQDLKNQLKHMSVS<br>SIKQAVDFLSNEGHIYSTVDDDHFKSTDAE<br>>sp\|P15927-2\|RFA2_HUMAN Isoform 2 of Replication protein A 32 kDa<br>subunit OS = Homo sapiens GN = RPA2<br>MGRGDRNKRSIRGFESYGSSSYGGAGGYTQSPGGFGSPAPSQAEKKSRARAQHIVPCTIS<br>QLLSATLVDEVFRIGNVEISQVTIVGIIRHAEKAPTNIVYKIDDMTAAPMDVRQWVDTDD<br>TSSENTVVPPETYVKVAGHLRSFQNKKSLVAFKIMPLEDMNEFTTHILEVINAHMVLSKA<br>NSQPSAGRAPISNPGMSEAGNFGGNSFMPANGLTVAQNQVLNLIKACPRPEGLNFQDLKN<br>QLKHMSVSSIKQAVDFLSNEGHIYSTVDDDHFKSTDAE<br>>sp\|P15927-3\|RFA2_HUMAN Isoform 3 of Replication protein A 32 kDa<br>subunit OS = Homo sapiens GN = RPA2<br>MWNSNDGGAGWRRKRIAGGFSKRASLGSERRVVAGEEGRERSWGVWGSPAGRRRGRLGRL<br>GQCLKGRSLREPAGFSEAWDVAQALILLFKTGGFESYGSSSYGGAGGYTQSPGGFGSPAP<br>SQAEKKSRARAQHIVPCTISQLLSATLVDEVFRIGNVEISQVTIVGIIRHAEKAPTNIVY<br>KIDDMTAAPMDVRQWVDTDDTSSENTVVPPETYVKVAGHLRSFQNKKSLVAFKIMPLEDM<br>NEFTTHILEVINAHMVLSKANSQPSAGRAPISNPGMSEAGNFGGNSFMPANGLTVAQNQV<br>LNLIKACPRPEGLNFQDLKNQLKHMSVSSIKQAVDFLSNEGHIYSTVDDDHFKSTDAE |
| RPA3 | See Table VI.2 |
| RAD52 | >sp\|P43351\|RAD52_HUMAN DNA repair protein RAD52 homolog OS = Homo<br>sapiens GN = RAD52 PE = 1 SV = 1<br>MSGTEEAILGGRDSHPAAGGGSVLCFGQCQYTAEEYQAIQKALRQRLGPEYISSRMAGGG<br>QKVCYIEGHRVINLANEMFGYNGWAHSITQQNVDFVDLNNGKFYVGVCAFVRVQLKDGSY<br>HEDVGYGVSEGLKSKALSLEKARKEAVTDGLKRALRSFGNALGNCILDKDYLRSLNKLPR<br>QLPLEVDLTKAKRQDLEPSVEEARYNSCRPNMALGHPQLQQVTSPSRPSHAVIPADQDCS<br>SRSLSSSAVESEATHQRKLRQKQLQQQFRERMEKQQVRVSTPSAEKSEAAPPAPPVTHST<br>PVTVSEPLLEKDFLAGVTQELIKTLEDNSEKWAVTPDAGDGVVKPSSRADPAQTSDTLAL<br>NNQMVTQNRTPHSVCHQKPQAKSGSWDLQTYSADQRTTGNWESHRKSQDMKKRKYDPS<br>>sp\|P43351-2\|RAD52_HUMAN Isoform beta of DNA repair protein RAD52<br>homolog OS = Homo sapiens GN = RAD52<br>MSGTEEAILGGRDSHPAAGGGSVLCFGQCQYTAEEYQAIQKALRQRLGPEYISSRMAGGG<br>QKVCYIEGHRVINLANEMFGYNGWAHSITQQNVDFVDLNNGKFYVGVCAFVRVQLKDGSY<br>HEDVGYGVSEGLKSKALSLEKARKEAVTDGLKRALRLPLLGVSGRILYSLFSVHSVMCAG<br>GLPTPTASAQTAPSSPCSSAVLRYAQEFWECTWKLYSGQRLPEITK<br>>sp\|P43351-3\|RAD52_HUMAN Isoform gamma of DNA repair protein<br>RAD52 homolog OS = Homo sapiens GN = RAD52<br>MSGTEEAILGGRDSHPAAGGGSVLCFGQCQYTAEEYQAIQKALRQRLGPEYISSRMAGGG<br>QKVCYIEGHRVINLANEMFGYNGWAHSITQQNVDFVDLNNGKFYVGVCAFVRVQLKVRGW<br>SRPAARKDQWVVGEGWFIS<br>>sp\|P43351-4\|RAD52_HUMAN Isoform delta of DNA repair protein<br>RAD52 homolog OS = Homo sapiens GN = RAD52<br>MSGTEEAILGGRDSHPAAGGGSVLCFGQCQYTAEEYQAIQKALRQRLGPEYISSRMAGGG<br>QKVCYIEGHRVINLANEMFGYNGWAHSITQQNVGEYALQQWGLLHCPAPAESLLWVRR |
| XPF | See Table VI.9 |
| ERCC1 | See Table VI.9 |
| a ligase— | |

More specifically, in some embodiments, the SSA down-regulator is an siRNA targeting Rad51, an siRNA targeting ERCC1, or an agent of Table VI.12 or any combination thereof. Inhibitors of some of the proteins of Table VI.11 above are also listed elsewhere in this specification.

TABLE VI.12

Down-regulators of SSA.

1. Rad52

| | |
|---|---|
| Compounds | Rad52 inhibitor deposited as PubChemAID: 651668 |
| siRNA | RAD52 Silencer, sold by Life Technologies; Accell Human RAD52 siRNA, sold by Dharmacon; Commercially available from Dharmacon or Ambion |
| antibodies | RAD52 antibody (C-term), sold by Abgent; RAD52 antibody, sold by Novus Biologicals |

2. ERCC1

| Compound | Reference |
|---|---|
| NSC 130813 | Jordheim et al (2013) MOL. PHARMACOL 84(1): 12-24. |
| siRNAs | ERCC1 excision repair cross-complementation group 1 siRNA, sold by Dharmacon; ERCC1 Silencer, sold by Life Technologies; Commercially available from Dharmacon or Ambion |
| antibodies | ERCC1 Antibody #3885, sold by Cell Signaling Technology; ERCC1 Antibody (8F1), sold by Novus Biologicals |

3. XPF

| Compounds | Reference |
|---|---|
| NSC 130813 | Jordheim et al (2013) MOL. PHARMACOL. 84(1): 12-24. |
| siRNAs | Commercially available from Dharmacon or Ambion |

VI.6 Single Strand Break Repair (SSBR)

Single-strand breaks (SSBs) in the genome are repaired by the SSBR pathway, which is a distinct mechanism from the DSB repair mechanisms discussed above (see FIG. 16). "SSBR", as used herein, refers to a DNA repair process that has four major stages: SSB detection, DNA end processing, DNA gap filling, and DNA ligation (see, e.g., Caldecott (2008) NAT. REV. GENET. 9: 619-31). A brief summary of SSBR is provided below.

In the first stage, when a SSB forms, PARP1 and/or PARP2 recognize the break and recruit the repair machinery. The binding and activity of PARP1 at DNA breaks is transient and appears to accelerate SSBR by promoting the focal accumulation or stability of SSBR protein complexes at the lesion. Arguably the most important of these SSBR proteins is XRCC1, which functions as a molecular scaffold that interacts with, stabilizes, and stimulates multiple enzymatic components of the SSBRr process including the protein responsible for processing the DNA 3' and 5' ends. For instance, XRCC1 interacts with several proteins (DNA polymerase beta, PNK, and three nucleases, APE1, APTX, and APLF) that promote end processing. APE1 has endonuclease activity. APLF has endonuclease and 3' to 5' exonuclease activities. APTX has endonuclease and 3' to 5' exonuclease activity. This end processing is an important stage of SSBR since the 3'- and/or 5'-termini of most, if not all, SSBs are "damaged". End processing generally involves restoring a damaged 3' end to a hydroxylated state and/or restoring a damaged 5' end to a phosphate moiety, thereby producing ligation-competent ends. Enzymes that process damaged 3' termini include PNKP, APE1, and TDP1. Enzymes that process damaged 5' termini include PNKP, DNA polymerase beta (Pol beta), and APTX. LIG3 (DNA ligase III) can also participate in end processing. Once the ends are cleaned, gap filling can occur.

At the DNA gap filling stage, the proteins typically present are PARP1, DNA polymerase beta, XRCC1, FEN1 (flap endonuclease 1), DNA polymerase delta/epsilon, PCNA, and LIG1. There are potentially two processes by which DNA gap filling occurs: short patch repair and long patch repair. Short patch repair involves the insertion of a single missing nucleotide. At some SSBs, gap filling might include displacing two or more nucleotides (displacement of up to 12 bases has been reported). FEN1 is an endonuclease that removes the displaced 5'-residues. Multiple DNA polymerases, including DNA polymerase beta, are involved in the repair of SSBs. The type of DNA polymerase that is recruited is dependent on the source and type of SSB.

In the fourth stage, a DNA ligase such as LIG1 (Ligase I) or LIG3 (Ligase III) catalyzes joining of the ends. Short patch repair uses Ligase III, while long patch repair uses Ligase I.

Sometimes, SSBR is coupled with replication, and may involve one or more of CtIP, MRN, ERCC1, and FEN1. SSBR is often cell-cycle dependent (see FIG. 16).

In some embodiments, HDR is promoted by down-regulating the SSBR pathway. For example, in some embodiments, a Cas9 molecule, e.g., a nickase, and a gRNA can induce a nick in a desired location during G1 or another phase of the cell cycle. A nick that is unrepaired in G1 will be converted into a DSB in S/G2 when a replication fork passes through the nicked area. In G2, the HDR machinery is active and can engage the break. Thus, an SSBR down-regulator can increase the likelihood that a break is repaired by HDR. A SSBR down-regulator can also increase the likelihood that a nick in G2 is repaired by HDR by preventing the cell from engaging the SSBR machinery during G2.

Accordingly, in some embodiments, the methods described herein involve down-regulating SSBR in order to promote HDR. For instance, the methods may involve modulating, e.g., inhibiting, a component (e.g., exactly one component, or one or more components, e.g., two or three components) of the SSBR pathway, e.g., a component of Table VI.13 or VI.1(F). More specifically, the methods may involve modulating, e.g., inhibiting, exactly one of, or one or more of a PARP, PARP1, PARP2, XRCC1, DNA polymerase beta (Pol beta), DNA polymerase delta, DNA polymerase epsilon, PCNA, LIG1, PNK, PNKP, APE1, APTX, APLF, TDP1, LIG3, FEN1, CtIP, MRN, and ERCC1. Up-regulation of HDR, in some embodiments, is achieved using siRNA directed against one or more of the components listed in Table VI.13 or VI.1(F). In some embodiments, a SSBR pathway is down regulated using an HDR-enhancing gRNA that targets a component of a SSBR pathway, e.g., one or more of the components listed in Table VI.13 or VI.1(F) (e.g., a PARP, PARP1, PARP2, XRCC1, DNA polymerase beta (Pol beta), DNA polymerase delta, DNA polymerase epsilon, PCNA, LIG1, PNK, PNKP, APE1, APTX, APLF, TDP1, LIG3, FEN1, CtIP, MRN, and ERCC1). In some embodiments, the HDR-enhancing gRNA is used in combination with an eiCas9 molecule. In some embodiments, the HDR-enhancing gRNA is used in combination with an eaCas9 molecule. In some embodiments, the HDR-enhancing gRNA is administered to the cell as a HDR-enhancing gRNA:Cas9 molecule complex.

In embodiments, one or more of HDR, alt-HR, anti-HR, NHEJ, MMEJ, SSA, MMR, NER, and BER are not substantially down-regulated, e.g., the only DNA damage repair pathway to be substantially down-regulated is the SSBR pathway.

TABLE VI.13

| | Factors that promote SSBR |
|---|---|
| a PARP | — |
| PARP1 | See Table VI.2 |
| PARP2 | See Table VI.2 |
| PARG | >sp\|Q86W56\|PARG_HUMAN Poly(ADP-ribose) glycohydrolase OS = Homo sapiens GN = PARG PE = 1 SV = 1<br>MNAGPGCEPCTKRPRWGAATTSPAASDARSFPSRQRRVLDPKDAHVQFRVPPSSPACVPG<br>RAGQHRGSATSLVFKQKTITSWMDTKGIKTAESESLDSKENNNTRIESMMSSVQKDNFYQ<br>HNVEKLENVSQLSLDKSPTEKSTQYLNQHQTAAMCKWQNEGKHTEQLLESEPQTVTLVPE<br>QFSNANIDRSPQNDDHSDTDSEENRDNQQFLTTVKLANAKQTTEDEQAREAKSHQKCSKS<br>CDPGEDCASCQQDEIDVVPESPLSDVGSEDVGTGPKNDNKLTRQESCLGNSPPFEKESEP<br>ESPMDVDNSKNSCQDSEADEETSPGFDEQEDGSSSQTANKPSRFQARDADIEFRKRYSTK<br>GGEVRLHFQFEGGESRTGMNDLNAKLPGNISSLNVECRNSKQHGKKDSKITDHFMRLPKA<br>EDRRKEQWETKHQRTERKIPKYVPPHLSPDKKWLGTPIEEMRRMPRCGIRLPLLRPSANH<br>TVTIRVDLLRAGEVPKPFPTHYKDLWDNKHVKMPCSEQNLYPVEDENGERTAGSRWELIQ<br>TALLNKFTRPQNLKDAILKYNVAYSKKWDFTALIDFWDKVLEEAEAQHLYQSILPDMVKI<br>ALCLPNICTQPIPLLKQKMNHSITMSQEQIASLLANAFFCTFPRRNAKMKSEYSSYPDIN<br>FNRLFEGRSSRKPEKLKTLFCYFRRVTEKKPTGLVTFTRQSLEDFPEWERCEKPLTRLHV<br>TYEGTIEENGQGMLQVDFANRFVGGGVTSAGLVQEEIRFLINPELIISRLFTEVLDHNEC<br>LIITGTEQYSEYTGYAETYRWSRSHEDGSERDDWQRRCTEIVAIDALHFRRYLDQFVPEK<br>MRRELNKAYCGFLRPGVSSENLSAVATGNWGCGAFGGDARLKALIQILAAAAAERDVVYF<br>TFGDSELMRDIYSMHIFLTERKLTVGDVYKLLLRYYNEECRNCSTPGPDIKLYPFIYHAV<br>ESCAETADHSGQRTGT<br>>sp\|Q86W56-2\|PARG_HUMAN Isoform 2 of Poly(ADP-ribose) glycohydrolase OS = Homo sapiens GN = PARG<br>MDTKGIKTAESESLDSKENNNTRIESMMSSVQKDNFYQHNVEKLENVSQLSLDKSPTEKS<br>TQYLNQHQTAAMCKWQNEGKHTEQLLESEPQTVTLVPEQFSNANIDRSPQNDDHSDTDSE<br>ENRDNQQFLTTVKLANAKQTTEDEQAREAKSHQKCSKSCDPGEDCASCQQDEIDVVPESP<br>LSDVGSEDVGTGPKNDNKLTRQESCLGNSPPFEKESEPESPMDVDNSKNSCQDSEADEET<br>SPGFDEQEDGSSSQTANKPSRFQARDADIEFRKRYSTKGGEVRLHFQFEGGESRTGMNDL<br>NAKLPGNISSLNVECRNSKQHGKKDSKITDHFMRLPKAEDRRKEQWETKHQRTERKIPKY<br>VPPHLSPDKKWLGTPIEEMRRMPRCGIRLPLLRPSANHTVTIRVDLLRAGEVPKPFPTHY<br>KDLWDNKHVKMPCSEQNLYPVEDENGERTAGSRWELIQTALLNKFTRPQNLKDAILKYNV<br>AYSKKWDFTALIDFWDKVLEEAEAQHLYQSILPDMVKIALCLPNICTQPIPLLKQKMNHS<br>ITMSQEQIASLLANAFFCTFPRRNAKMKSEYSSYPDINFNRLFEGRSSRKPEKLKTLFCY<br>FRRVTEKKPTGLVTFTRQSLEDFPEWERCEKPLTRLHVTYEGTIEENGQGMLQVDFANRF<br>VGGGVTSAGLVQEEIRFLINPELIISRLFTEVLDHNECLIITGTEQYSEYTGYAETYRWS<br>RSHEDGSERDDWQRRCTEIVAIDALHFRRYLDQFVPEKMRRELNKAYCGFLRPGVSSENL<br>SAVATGNWGCGAFGGDARLKALIQILAAAAAERDVVYFTFGDSELMRDIYSMHIFLTERK<br>LTVGDVYKLLLRYYNEECRNCSTPGPDIKLYPFIYHAVESCAETADHSGQRTGT<br>>sp\|Q86W56-3\|PARG_HUMAN Isoform 3 of Poly(ADP-ribose) glycohydrolase OS = Homo sapiens GN = PARG<br>MMSSVQKDNFYQHNVEKLENVSQLSLDKSPTEKSTQYLNQHQTAAMCKWQNEGKHTEQLL<br>ESEPQTVTLVPEQFSNANIDRSPQNDDHSDTDSEENRDNQQFLTTVKLANAKQTTEDEQA<br>REAKSHQKCSKSCDPGEDCASCQQDEIDVVPESPLSDVGSEDVGTGPKNDNKLTRQESCL<br>GNSPPFEKESEPESPMDVDNSKNSCQDSEADEETSPGFDEQEDGSSSQTANKPSRFQARD<br>ADIEFRKRYSTKGGEVRLHFQFEGGESRTGMNDLNAKLPGNISSLNVECRNSKQHGKKDS<br>KITDHFMRLPKAEDRRKEQWETKHQRTERKIPKYVPPHLSPDKKWLGTPIEEMRRMPRCG<br>IRLPLLRPSANHTVTIRVDLLRAGEVPKPFPTHYKDLWDNKHVKMPCSEQNLYPVEDENG<br>ERTAGSRWELIQTALLNKFTRPQNLKDAILKYNVAYSKKWDFTALIDFWDKVLEEAEAQH<br>LYQSILPDMVKIALCLPNICTQPIPLLKQKMNHSITMSQEQIASLLANAFFCTFPRRNAK<br>MKSEYSSYPDINFNRLFEGRSSRKPEKLKTLFCYFRRVTEKKPTGLVTFTRQSLEDFPEW<br>ERCEKPLTRLHVTYEGTIEENGQGMLQVDFANRFVGGGVTSAGLVQEEIRFLINPELIIS<br>RLFTEVLDHNECLIITGTEQYSEYTGYAETYRWSRSHEDGSERDDWQRRCTEIVAIDALH<br>FRRYLDQFVPEKMRRELNKAYCGFLRPGVSSENLSAVATGNWGCGAFGGDARLKALIQIL<br>AAAAAERDVVYFTFGDSELMRDIYSMHIFLTERKLTVGDVYKLLLRYYNEECRNCSTPGP<br>DIKLYPFIYHAVESCAETADHSGQRTGT<br>>sp\|Q86W56-4\|PARG_HUMAN Isoform 4 of Poly(ADP-ribose) glycohydrolase OS = Homo sapiens GN = PARG<br>MVQAGAEKDAQSISLRKEQWETKHQRTERKIPKYVPPHLSPDKKWLGTPIEEMRRMPRCG<br>IRLPLLRPSANHTVTIWNGERTAGSRWELIQTALLNKFTRPQNLKDAILKYNVAYSKKWD<br>FTALIDFWDKVLEEAEAQHLYQSILPDMVKIALCLPNICTQPIPLLKQKMNHSITMSQEQ<br>IASLLANAFFCTFPRRNAKMKSEYSSYPDINFNRLFEGRSSRKPEKLKTLFCYFRRVTEK<br>KPTGLVTFTRQSLEDFPEWERCEKPLTRLHVTYEGTIEENGQGMLQVDFANRFVGGGVTS<br>AGLVQEEIRFLINPELIISRLFTEVLDHNECLIITGTEQYSEYTGYAETYRWSRSHEDGS<br>ERDDWQRRCTEIVAIDALHFRRYLDQFVPEKMRRELNKAYCGFLRPGVSSENLSAVATGN<br>WGCGAFGGDARLKALIQILAAAAAERDVVYFTFGDSELMRDIYSMHIFLTERKLTVGDVY<br>KLLLRYYNEECRNCSTPGPDIKLYPFIYHAVESCAETADHSGQRTGT<br>>sp\|Q86W56-5\|PARG_HUMAN Isoform 5 of Poly(ADP-ribose) glycohydrolase OS = Homo sapiens GN = PARG<br>MRRMPRCGIRLPLLRPSANHTVTIWNGERTAGSRWELIQTALLNKFTRPQNLKDAILKYN<br>VAYSKKWDFTALIDFWDKVLEEAEAQHLYQSILPDMVKIALCLPNICTQPIPLLKQKMNH<br>SITMSQEQIASLLANAFFCTFPRRNAKMKSEYSSYPDINFNRLFEGRSSRKPEKLKTLFC<br>YFRRVTEKKPTGLVTFTRQSLEDFPEWERCEKPLTRLHVTYEGTIEENGQGMLQVDFANR<br>FVGGGVTSAGLVQEEIRFLINPELIISRLFTEVLDHNECLIITGTEQYSEYTGYAETYRW<br>SRSHEDGSERDDWQRRCTEIVAIDALHFRRYLDQFVPEKMRRELNKAYCGFLRPGVSSEN |

TABLE VI.13-continued

Factors that promote SSBR

|  |  |
|---|---|
|  | LSAVATGNWGCGAFGGDARLKALIQILAAAAAERDVVYFTFGDSELMRDIYSMHIFLTER<br>KLTVGDVYKLLLRYYNEECRNCSTPGPDIKLYPFIYHAVESCAETADHSGQRTGT |
| XRCC1 | See Table VI.9 |
| DNA polymerase beta | MSLRSGGRRRADPGADGEASRDDGATSSVSALKRLERSQWTDKMDLRFGFERLKEPGEKTGWLINMHPTE<br>ILDEDKRLGSAVDYYFIQDDGSRFKVALPYKPYFYIATRKGCEREVSSFLSKKFQGKIAKVETVPKEDLD<br>LPNHLVGLKRNYIRLSFHTVEDLVKVRKEISPAVKKNREQDHASDAYTALLSSVLQRGGVITDEEETSKK<br>IADQLDNIVDMREYDVPYHIRLSIDLKIHVAHWYNVRYRGNAFPVEITRRDDLVERPDPVVLAFDIETTK<br>LPLKFPDAETDQIMMISYMIDGQGYLITNREIVSEDIEDFEFTPKPEYEGPPCVFNEPDEAHLIQRWFEH<br>VQETKPTIMVTYNGDFFDWPFVEARAAVHGLSMQQEIGFQKDSQGEYKAPQCIHMDCLRWVKRDSYLPVG<br>SHNLKAAAKAKLGYDPVELDPEDMCRMATEQPQTLATYSVSDAVATYYLYMKYVHPFIFALCTIIPMEPD<br>EVLRKGSGTLCEALLMVQAFHANIIFPNKQEQEFNKLTDDGHVLDSETYVGGHVEALESGVFRSDIPCRF<br>RMNPAAFDFLLQRVEKTLRHALEEEEKVPVEQVTNFEEVCDEIKSKLASLKDVPSRIECPLIYHLDVGAM<br>YPNIILTNRLQPSAMVDEATCAACDFNKPGANCQRKMAWQWRGEFMPASRSEYHRIQHQLESEKFPPLFP<br>EGPARAFHELSREEQAKYEKRRLADYCRKAYKKIHITKVEERLTTICQRENSFYVDTVRAFRDRRYEFKG<br>LHKVWKKKLSAAVEVGDAAEVKRCKNMEVLYDSLQLAHKCILNSFYGYVMRKGARWYSMEMAGIVCFTGA<br>NIITQARELIEQIGRPLELDTDGIWCVLPNSFPENFVFKTTNVKKPKVTISYPGAMLNIMVKEGFTNDQY<br>QELAEPSSLTYVTRSENSIFFEVDGPYLAMILPASKEEGKKLKKRYAVFNEDGSLAELKGFEVKRRGELQ<br>LIKIFQSSVFEAFLKGSTLEEVYGSVAKVADYWLDVLYSKAANMPDSELFELISENRSMSRKLEDYGEQK<br>STSISTAKRLAEFLGDQMVKDAGLSCRYIISRKPEGSPVTERAIPLAIFQAEPTVRKHFLRKWLKSSSLQ<br>DFDIRAILDWDYYIERLGSAIQKIITIPAALQQVKNPVPRVKHPDWLHKKLLEKNDVYKQKKISELFTLE<br>GRRQVTMAEASEDSPRPSAPDMEDFGLVKLPHPAAPVTVKRKRVLWESQEESQDLTPTVPWQEILGQPPA<br>LGTSQEEWLVWLRFHKKKWQLQARQRLARRKRQRLESAEGVLRPGAIRDGPATGLGSFLRRTARSILDLP<br>WQIVQISETSQAGLFRLWALVGSDLHCIRLSIPRVFYVNQRVAKAEEGASYRKVNRVLPRSNMVYNLYEY<br>SVPEDMYQEHINEINAELSAPDIEGVYETQVPLLFRALVHLGCVCVVNKQLVRHLSGWEAETFALEHLEM<br>RSLAQFSYLEPGSIRHIYLYHHAQAHKALFGIFIPSQRRASVFVLDTVRSNQMPSLGALYSAEHGLLLEK<br>VGPELLPPPKHTFEVRAETDLKTICRAIQRFLLAYKEERRGPTLIAVQSSWELKRLASEIPVLEEFPLVP<br>ICVADKINYGVLDWQRHGARRMIRHYLNLDTCLSQAFEMSRYFHIPIGNLPEDISTFGSDLFFARHLQRH<br>NHLLWLSPTARPDLGGKEADDNCLVMEFDDQATVEINSSGCYSTVCVELDLQNLAVNTILQSHHVNDMEG<br>ADSMGISFDVIQQASLEDMITGGQAASAPASYDETALCSNTFRILKSMVVGWVKEITQYHNIYADNQVMH<br>FYRWLRSPSSLLHDPALHRTLHNMMKKLFLQLIAEFKRLGSSVIYANFNRIILCTKKRRVEDAIAYVEYI<br>TSSIHSKETFHSLTISFSRCWEFLLWMDPSNYGGIKGKVSSRIHCGLQDSQKAGGAEDEQENEDDEEERD<br>GEEEEEAEESNVEDLLENNWNILQFLPQAASCQNYFLMIVSAYIVAVYHCMKDGLRRSAPGSTPVRRRGA<br>SQLSQEAEGAVGALPGMITFSQDYVANELTQSFFTITQKIQKKVTGSRNSTELSEMFPVLPGSHLLLNNP<br>ALEFIKYVCKVLSLDTNITNQVNKLNRDLLRLVDVGEFSEEAQFRDPCRSYVLPEVICRSCNFCRDLDLC<br>KDSSFSEDGAVLPQWLCSNCQAPYDSSAIEMTLVEVLQKKLMAFTLQDLVCLKCRGVKETSMPVYCSCAG<br>DFALTIHTQVFMEQIGIFRNIAQHYGMSYLLETLEWLLQKNPQLGH |
| DNA polymerase delta | MFSEQAAQRAHTLLSPPSANNATFARVPVATYTNSSQPFRLGERSFSRQYAHIYATRLIQMRPFLENRAQ<br>QHWGSGVGVKKLCELQPEEKCCVVGTLFKAMPLQPSILREVSEEHNLLPQPPRSKYIHPDDELVLEDELQ<br>RIKLKGTIDVSKLVTGTVLAVFGSVRDDGKFLVEDYCFADLAPQKPAPPLDTDRFVLLVSGLGLGGGGGE<br>SLLGTQLLVDVVTGQLGDEGEQCSAAHVSRVILAGNLLSHSTQSRDSINKAKYLTKKTQAASVEAVKMLD<br>EILLQLSASVPVDVMPGEFDPTNYTLPQQPLHPCMFPLATAYSTLQLVTNPYQATIDGVRFLGTSGQNVS<br>DIFRYSSMEDHLEILEWTLRVRHISPTAPDTLGCYPFYKTDPFIFPECPHVYFCGNTPSFGSKIIRGPED<br>QTVLLVTVPDFSATQTACLVNLRSLACQPISFSGFGAEDDDLGGLGLGP (Pol delta2,<br>sequence 1)<br>MGGAGARGLAGCGAPRVNLLGLGEAVWTKQVRSVAMFSEQAAQRAHTLLSPPSANNATFARVPVATYTNS<br>SQPFRLGERSFSRQYAHIYATRLIQMRPFLENRAQQHWGSGVGVKKLCELQPEEKCCVVGTLFKAMPLQP<br>SILREVSEEHNLLPQPPRSKYIHPDDELVLEDELQRIKLKGTIDVSKLVTGTVLAVFGSVRDDGKFLVED<br>YCFADLAPQKPAPPLDTDRFVLLVSGLGLGGGGGESLLGTQLLVDVVTGQLGDEGEQCSAAHVSRVILAG<br>NLLSHSTQSRDSINKAKYLTKKTQAASVEAVKMLDEILLQLSASVPVDVMPGEFDPTNYTLPQQPLHPCM<br>FPLATAYSTLQLVTNPYQATIDGVRFLGTSGQNVSDIFRYSSMEDHLEILEWTLRVRHISPTAPDTLGCY<br>PPYKTDPFIFPECPHVYFCGNTPSFGSKIIRGPEDQTVLLVTVPDFSATQTACLVNLRSLACQPISFSGF<br>GAEDDDLGGLGLGP (Pol delta2, sequence 2)<br>MADQLYLENIDEFVTDQNKIVTYKWLSYTLGVHVNQAKQMLYDYVERKRKENSGAQLHVTYLVSGSLIQN<br>GHSCHKVAVVREDKLEAVKSKLAVTASIHVYSIQKAMLKDSGPLFNTDYDILKSNLQNCSKFSAIQCAAA<br>VPRAPAESSSSSKKFEQSHLHMSSETQANNELTTNGHGPPASKQVSQQPKGIMGMFASKAAAKTQETNKE<br>TKTEAKEVTNASAAGNKAPGKGNMMSNFFGKAAMNKFKVNLDSEQAVKEEKIVEQPTVSVTEPKLATPAG<br>LKKSSSKKAEPVKVLQKEKKRGKRVALSDDETKETENMRKKRRRIKLPESDSSEDEVPPDSPGAYEAESPS<br>PPPPPSPPLEPVPKTEPEPPSVKSSSGENKRKRKRVLKSKTYLDGEGCIVTEKVYESESCTDSEEELNMK<br>TSSVHRPPAMTVKKEPREERKGPKKGTAALGKANRQVSITGFFQRK (Pol delta3) |
| DNA polymerase epsilon | MSLRSGGRRRADPGADGEASRDDGATSSVSALKRLERSQWTDKMDLRFGFERLKEPGEKTGWLINMHPTE<br>ILDEDKRLGSAVDYYFIQDDGSRFKVALPYKPYFYIATRKGCEREVSSFLSKKFQGKIAKVETVPKEDLD<br>LPNHLVGLKRNYIRLSFHTVEDLVKVRKEISPAVKKNREQDHASDAYTALLSSVLQRGGVITDEEETSKK<br>IADQLDNIVDMREYDVPYHIRLSIDLKIHVAHWYNVRYRGNAFPVEITRRDDLVERPDPVVLAFDIETTK<br>LPLKFPDAETDQIMMISYMIDGQGYLITNREIVSEDIEDFEFTPKPEYEGPPCVFNEPDEAHLIQRWFEH<br>VQETKPTIMVTYNGDFFDWPFVEARAAVHGLSMQQEIGFQKDSQGEYKAPQCIHMDCLRWVKRDSYLPVG<br>SHNLKAAAKAKLGYDPVELDPEDMCRMATEQPQTLATYSVSDAVATYYLYMKYVHPFIFALCTIIPMEPD<br>EVLRKGSGTLCEALLMVQAFHANIIFPNKQEQEFNKLTDDGHVLDSETYVGGHVEALESGVFRSDIPCRF<br>RMNPAAFDFLLQRVEKTLRHALEEEEKVPVEQVTNFEEVCDEIKSKLASLKDVPSRIECPLIYHLDVGAM<br>YPNIILTNRLQPSAMVDEATCAACDFNKPGANCQRKMAWQWRGEFMPASRSEYHRIQHQLESEKFPPLFP<br>EGPARAFHELSREEQAKYEKRRLADYCRKAYKKIHITKVEERLTTICQRENSFYVDTVRAFRDRRYEFKG<br>LHKVWKKKLSAAVEVGDAAEVKRCKNMEVLYDSLQLAHKCILNSFYGYVMRKGARWYSMEMAGIVCFTGA<br>NIITQARELIEQIGRPLELDTDGIWCVLPNSFPENFVFKTTNVKKPKVTISYPGAMLNIMVKEGFTNDQY<br>QELAEPSSLTYVTRSENSIFFEVDGPYLAMILPASKEEGKKLKKRYAVFNEDGSLAELKGFEVKRRGELQ<br>LIKIFQSSVFEAFLKGSTLEEVYGSVAKVADYWLDVLYSKAANMPDSELFELISENRSMSRKLEDYGEQK |

TABLE VI.13-continued

Factors that promote SSBR

|  |  |
|---|---|
|  | STSISTAKRLAEFLGDQMVKDAGLSCRYIISRKPEGSPVTERAIPLAIFQAEPTVRKHFLRKWLKSSSLQ<br>DPDIRAILDWDYYIERLGSAIQKIITIPAALQQVKNPVPRVKHPDWLHKKLLEKNDVYKQKKISELFTLE<br>GRRQVTMAEASEDSPRPSAPDMEDFGLVKLPHPAAPVTVKRKRVLWESQEESQDLTPTVPWQEILGQPPA<br>LGTSQEEWLVMLRFHKKKWQLQARQRLARRKQRLESAEGVLRPGAIRDGPATGLGSFLRRTARSILDLP<br>WQIVQISETSQAGLFRLWALVGSDLHCIRLSIPRVFYVNQRVAKAEEGASYRKVNRVLPRSNMVYNLYEY<br>SVPEDMYQEHINEINAELSAPDIEGVYETQVPLLFRALVHLGCVCVVNKQLVRHLSGWEAETFALEHLEM<br>RSLAQFSYLEPGSIRHIYLYHHAQAHKALFGIFIPSQRRASVFVLDTVRSNQMPSLGALYSAEHGLLLEK<br>VGPELLPPPKHTFEVRAETDLKTICRAIQRFLLAYKEERRGPTLIAVQSSWELKRLASEIPVLEEFPLVP<br>ICVADKINYGVLDWQRHGARRMIRHYLNLDTCLSQAFEMSRYFHIPIGNLPEDISTFGSDLFFARHLQRH<br>NHLLWLSPTARPDLGGKEADDNCLVMEFDDQATVEINSSGCYSTVCVELDLQNLAVNTILQSHHVNDMEG<br>ADSMGISFDVIQQASLEDMITGGQAASAPASYDETALCSNTFRILKSMVVGWVKEITQYHNIYADNQVMH<br>FYRWLRSPSSLLHDPALHRTLHNMMKKLFLQLIAEFKRLGSSVIYANFNRIILCTKKRRVEDAIAYVEYI<br>TSSIHSKETFHSLTISFSRCWEFLLWMDPSNYGGIKGKVSSRIHCGLQDSQKAGGAEDEQENEDDEEERD<br>GEEEEEAEESNVEDLLENNWNILQFLPQAASCQNYFLMIVSAYIVAVYHCMKDGLRRSAPGSTPVRRRGA<br>SQLSQEAEGAVGALPGMITFSQDYVANELTQSFFTITQKIQKKVTGSRNSTELSEMFPVLPGSHLLLNNP<br>ALEFIKYVCKVLSLDTNITNQVNKLNRDLLRLVDVGEFSEEAQFRDPCRSYVPLEVICRSCNFCRDLDLC<br>KDSSFSEDGAVLPQWLCSNCQAPYDSSAIEMTLVEVLQKKLMAFTLQDLVCLKCRGVKETSMPVYCSCAG<br>DFALTIHTQVFMEQIGIFRNIAQHYGMSYLLETLEWLLQKNPQLGH |
| PCNA | >sp\|P12004\|PCNA_HUMAN Proliferating cell nuclear antigen OS = Homo<br>sapiens GN = PCNA PE = 1 SV = 1<br>MFEARLVQGSILKKVLEALKDLINEACWDISSSGVNLQSMDSSHVSLVQLTLRSEGFDTY<br>RCDRNLAMGVNLTSMSKILKCAGNEDIITLRAEDNADTLALVFEAPNQEKVSDYEMKLMD<br>LDVEQLGIPEQEYSCVVKMPSGEFARICRDLSHIGDAVVISCAKDGVKFSASGELGNGNI<br>KLSQTSNVDKEEEAVTIEMNEPVQLTFALRYLNFFTKATPLSSTVTLSMSADVPLVVEYK<br>IADMGHLKYYLAPKIEDEEGS |
| LIG1 | See Table VI.9 |
| PNK | See Table VI.7 |
| APE1 | MPKRGKKGAVAEDGDELRTEPEAKKSKTAAKKNDKEAAGEGPALYEDPPDQKTSPSGKPA<br>TLKICSWNVDGLRAWIKKKGLDWVKEEAPDILCLQETKCSENKLPAELQELPGLSHQYWS<br>APSDKEGYSGVGLLSRQCPLKVSYGIGDEEHDQEGRVIVAEFDSFVLVTAYVPNAGRGLV<br>RLEYRQRWDEAFRKFLKGLASRKPLVLCGDLNVAHEEIDLRNPKGNKKNAGFTPQERQGF<br>GELLQAVPLADSFRHLYPNTPYAYTFWTYMMNARSKNVGWRLDYFLLSHSLLPALCDSKI<br>RSKALGSDHCPITLYLAL (APE-1 CCDS 9550.1) |
| APTX | MMRVCWLVRQDSRHQRIRLPHLEAVVIGRGPETKITDKKCSRQQVQLKAECNKGYVKVKQ<br>VGVNPTSIDSVVIGKDQEVKLQPGQVLHMVNELYPYIVEFEEEAKNPGLETHRKRKRSGN<br>SDSIERDAAQEAEAGTGLEPGSNSGQCSVPLKKGKDAPIKKESLGHWSQGLKISMQDPKM<br>QVYKDEQVVVIKDKYPKARYHWLVLPWTSISSLKAVAREHLELLKHMHTVGEKVIVDFAG<br>SSKLRFRLGYHAIPSMSHVHLHVISQDFDSPCLKNKKHWNSFNTEYFLESQAVIEMVQEA<br>GRVTVRDGMPELLKLPLRCHECQQLLPSIPQLKEHLRKHWTQ (APTX Isoform 1<br>CCDS 47956.1)<br>MSNVNLSVSDFWRVMMRVCWLVRQDSRHQRIRLPHLEAVVIGRGPETKITDKKCSRQQEF<br>EEEEAKNPGLETHRKRKRSGNSDSIERDAAQEAEAGTGLEPGSNSGQCSVPLKKGKDAPIK<br>KESLGHWSQGLKISMQDPKMQVYKDEQVVVIKDKYPKARYHWLVLPWTSISSLKAVAREH<br>LELLKHMHTVGEKVIVDFAGSSKLRFRLGYHAIPSMSHVHLHVISQDFDSPCLKNKKHWN<br>SFNTEYFLESQAVIEMVQEAGRVTVRDGMPELLKLPLRCHECQQLLPSIPQLKEHLRKHW<br>TQ (APTX Isoform 2 CCDS 56568.1)<br>MMRVCWLVRQDSRHQRIRLPHLEAVVIGRGPETKITDKKCSRQQEFEEEEAKNPGLETHRK<br>RKRSGNSDSIERDAAQEAEAGTGLEPGSNSGQCSVPLKKGKDAPIKKESLGHWSQGLKIS<br>MQDPKMQVYKDEQVVVIKDKYPKARYHWLVLPWTSISSLKAVAREHLELLKHMHTVGEKV<br>IVDFAGSSKLRFRLGYHAIPSMSHVHLHVISQDFDSPCLKNKKHWNSFNTEYFLESQAVI<br>EMVQEAGRVTVRDGMPELLKLPLRCHECQQLLPSIPQLKEHLRKHWTQ (APTX<br>Isoform 3 CCDS 75827.1) |
| APLF | MSGGFELQPRDGGPRVALAPGETVIGRGPLLGITDKRVSRRHAILEVAGGQLRIKPIHTN<br>PCFYQSSEKSQLLPLKPNLWCYLNPGDSFSLLVDKYIFRILSIPSEVEMQCTLRNSQVLD<br>EDNILNETPKSPVINLPHETTGASQLEGSTEIAKTQMTPTNSVSFLGENRDCNKQQPILA<br>ERKRILPTWMLAEHLSDQNLSVPAISGGNVIQGSGKEEICKDKSQLNTTQQGRRQLISSG<br>SSENTSAEQDTGEECKNTDQEESTISSKEMPQSFSAITLSNTEMNNIKTNAQRNKLPIEE<br>LGKVSKHKIATKRTPHKEDEAMSCSENCSSAQGDSLQDESQGSHSESSSNPSNPETLHAK<br>ATDSVLQGSEGNKVKRTSCMYGANCYRKNPVHFQHFSHPGDSDYGGVQIVGQDETDDRPE<br>CPYGPSCYRKNPQHKIEYRHNTLPVRNVLDEDNDNVGQPNEYDLNDSFLDDEEEDYEPTD<br>EDSDWEPGKEDEEKEDVEELLKEAKRFMKRK (APLF CCDS 1888.1) |
| TDP1 | >tr\|Q9BRS7\|Q9BRS7_HUMAN TDP1 protein OS = Homo sapiens GN = TDP1 PE = 1 SV = 1<br>MSQEGDYGRWTISSSDESEEEKPKPDKPSTSLLCARQGAANEPRYTCSEAQKAAHKRKI<br>SPVKFSNTDSVLPPKRQKSGSQEDLGWCLSSSDDELQPEMPQKQAEKVVIKKEKDISAPN<br>DGTAQRTENHGAPACHRLKEEEDEYETSGEGQDIWDMLDKGNPFQFYLTRVSGVKPKYNS<br>GALHIKDILSPLFGTLVSSAQFNYCFDVDWLVKQYPPEFRKKPILLVHGDKREAKAHLHA<br>QAKPYENISLCQAKLDIAFGTHHTKMMLLLYEEGLRVVIHTSNLIHADWHQKTQGTHL |
| LIG3 | See Table VI.9 |
| FEN1 | See Table VI.2 |

TABLE VI.13-continued

Factors that promote SSBR

| | |
|---|---|
| CtIP | See Table VI.2 |
| MRN | — |
| ERCC1 | See Table VI.9 |

More specifically, in some embodiments, the SSBR down-regulator is an inhibitor of a PARP such as AZD2281 (also called Olaparib and KU-0059436) or niraparib (produced by Tesero), BMN673 (produced by BioMarin Pharmaceutical), or rucaparib (produced by Clovis Oncology), an siRNA targeting XRCC1, or an agent Table VI.14, or any combination thereof. Inhibitors of some of the proteins of Table VI.13 above are also listed elsewhere in this specification.

TABLE VI.14

Down-regulators of SSBR

1. PARP

| Compounds | Phase |
|---|---|
| Olaparib (also known as AZD2281 and KU-0059436) | Phase III |
| Iniparib (also known as BSI-201) | Phase III |
| BMN 673 | Phase III |
| Rucaparib (also known as AGO 14699 and PF-01367338) | Phase II |
| Veliparib (also known as ABT-888) | Phase II |
| CEP 9722 | Phase II |
| INO-1001 | Phase I/II |
| MK 4827 | Phase I |
| BGB-290 | Phase I |
| E701 (also known as GPI21016) | Phase I |
| MP-124 | Phase I |
| LT-673 | Preclinical |
| NMS-P118 | Preclinical |
| XAV939 | Preclinical |
| 3-aminobenzamide | Preclinical (highly selective against PARP-5) |

PARP1 siRNAs

Accell Human PARP1 siRNA, sold by Dharmacon
PARP1 Silencer, sold by Life Technologies PARP1 antibodies PARP1 antibody, sold by Proteintech Group Inc.
PARP1 monoclonal antibody (M01), clone 3G4, sold by Abnova PARP2 siRNAs PARP2 Silencer, sold by Life Technologies
Accell Human PARP2 siRNA, sold by Dharmacon PARP2 antibodies Anti-PARP-2, clone 4G8 antibody, sold by EMD Millipore
PARP2 Antibody, sold by ProSci 2. XRCC1
siRNA XRCC1 Silencer, sold by Life Technologies
Accell Human XRCC1 siRNA, sold by Dharmacon
Commercially available siRNAs from Dharmacon or Ambion antibodies Anti-XRCC1 antibody, sold by Boster
XRCC1 mouse monoclonal antibody, clone 2D8, sold by OriGene Technologies VI.7 Mismatch Repair (MMR)

Cells contain three excision repair pathways: MMR, BER, and NER. The excision repair pathways have a common feature in that they typically recognize a lesion on one strand of the DNA, then exo/endonucleases remove the lesion and leave a 1-30 nucleotide gap that is subsequentially filled-in by DNA polymerase, and finally sealed by a ligase (see, e.g., Li (2008) CELL RESEARCH 18(1): 85-98). A brief description of the MMR is provided below.

Mismatch repair (MMR) operates on mispaired DNA bases. The MSH2/6 or MSH2/3 complexes both have ATPase activities that play an important role in mismatch recognition and the initiation of repair. MSH2/6 preferentially recognizes base-base mismatches and identifies mispairs of 1 or 2 nucleotides, while MSH2/3 preferentially recognizes larger insertion/deletion (ID) mispairs.

hMLH1 heterodimerizes with hPMS2 to form hMutLα, which possesses an ATPase activity, and is important for multiple steps of MMR. It possesses a PCNA/replication factor C (RFC)-dependent endonuclease activity which plays an important role in 3' nick-directed MMR involving EXO1. (EXO1 is a participant in both HDR and MMR.) It regulates termination of mismatch-provoked excision. Ligase I is the relevant ligase for this pathway.

In some embodiments, the methods herein include down-regulating the MMR pathway in order to increase the frequency of successful genome editing. While not wishing to be bound by theory, MMR down-regulation could operate through the following mechanism. In some arrangements, genome editing will lead to a mismatch between the old and the new strand. Because MMR typically utilizes the original strand as the template, and therefore has a bias towards reverting back to the original sequence, down-regulation of MMR should enhance gene correction.

Accordingly, in some embodiments, the methods herein involve down-regulating the MMR pathway in order to promote HDR (e.g., HR, alt-HR or SSA). For instance, in some embodiments, the methods may involve modulating, e.g., inhibiting, a component (e.g., exactly one component, or one or more components, e.g., two or three components) of the MMR pathway, e.g., a component of Table VI.15 or VI.1(H). More specifically, in some embodiments, the methods may involve modulating, e.g., inhibiting, exactly one of, or one or more of EXO1, MSH2, MSH3, MSH6, MLH1, PMS2, MLH3, DNA Polymerase delta, RPA, HMGB1, RFC, and DNA ligase I. Up-regulation of HDR, in some embodiments, is achieved using siRNA directed against one or more of the components listed in Table VI.15 or VI.1(H). In some embodiments, a MMR pathway is down regulated using an HDR-enhancing gRNA that targets a component of a MMR pathway, e.g., one or more of the components listed in Table VI.15 or VI.1(H) (e.g., one or more of EXO1, MSH2, MSH3, MSH6, MLH1, PMS2, MLH3, DNA Polymerase delta, RPA, HMGB1, RFC, and DNA ligase I). In some embodiments, the HDR-enhancing gRNA is used incombination with an eiCas9 molecule. In some embodiments, the HDR-enhancing gRNA is used in combination with an eaCas9 molecule. In some embodiments, the HDR-enhancing gRNA is administered to the cell as a HDR-enhancing gRNA:Cas9 molecule complex.

In some embodiments, one or more of HDR, alt-HR, anti-HR, NHEJ, MMEJ, SSA, SSBR, NER, and BER are not substantially down-regulated, e.g., in some embodiments the only DNA damage repair pathway to be substantially down-regulated is the MMR pathway.

TABLE VI.15

Factors involved in MMR.

| Factor | Sequence |
|---|---|
| EXO1 | See Table VI.2 |
| MSH2 | >sp\|P43246\|MSH2_HUMAN DNA mismatch repair protein Msh2 OS = Homo sapiens GN = MSH2 PE = 1 SV = 1<br>MAVQPKETLQLESAAEVGFVRFFQGMPEKPTTTVRLFDRGDFYTAHGEDALLAAREVFKT<br>QGVIKYMGPAGAKNLQSVVLSKMNFESFVKDLLLVRQYRVEVYKNRAGNKASKENDWYLA<br>YKASPGNLSQFEDILFGNNDMSASIGVVGVKMSAVDGQRQVGVGYVDSIQRKLGLCEFPD<br>NDQFSNLEALLIQIGPKECVLPGGETAGDMGKLRQIIQRGGILITERKKADFSTKDIYQD<br>LNRLLKGKKGEQMNSAVLPEMENQVAVSSLSAVIKFLELLSDDSNFGQFELTTFDFSQYM<br>KLDIAAVRALNLFQGSVEDTTGSQSLAALLNKCKTPQGQRLVNQWIKQPLMDKNRIEERL<br>NLVEAFVEDAELRQTLQEDLLRRFPDLNRLAKKFQRQAANLQDCYRLYQGINQLPNVIQA<br>LEKHEGKHQKLLLAVFVTPLTDLRSDFSKFQEMIETTLDMDQVENHEFLVKPSFDPNLSE<br>LREIMNDLEKKMQSTLISAARDLGLDPGKQIKLDSSAQFGYYFRVTCKEEKVLRNNKNFS<br>TVDIQKNGVKFTNSKLTSLNEEYTKNKTEYEEAQDAIVKEIVNISSGYVEPMQTLNDVLA<br>QLDAVVSFAHVSNGAPVPYVRPAILEKGQGRIILKASRHACVEVQDEIAFIPNDVYFEKD<br>KQMFHIITGPNMGGKSTYIRQTGVIVLMAQIGCFVPCESAEVSIVDCILARVGAGDSQLK<br>GVSTFMAEMLETASILRSATKDSLIIIDELGRGTSTYDGFGLAWAISEYIATKIGAFCMF<br>ATHFHELTALANQIPTVNNLHVTALTTEETLTMLYQVKKGVCDQSFGIHVAELANFPKHV<br>IECAKQKALELEEFQYIGESQGYDIMEPAAKKCYLEREQGEKIIQEFLSKVKQMPFTEMS<br>EENITIKLKQLKAEVIAKNNSFVNEIISRIKVTT<br>>sp\|P43246-2\|MSH2_HUMAN Isoform 2 of DNA mismatch repair protein Msh2 OS = Homo sapiens GN = MSH2<br>MGPAGAKNLQSVVLSKMNFESFVKDLLLVRQYRVEVYKNRAGNKASKENDWYLAYKASPG<br>NLSQFEDILFGNNDMSASIGVVGVKMSAVDGQRQVGVGYVDSIQRKLGLCEFPDNDQFSN<br>LEALLIQIGPKECVLPGGETAGDMGKLRQIIQRGGILITERKKADFSTKDIYQDLNRLLK<br>GKKGEQMNSAVLPEMENQVAVSSLSAVIKFLELLSDDSNFGQFELTTFDFSQYMKLDIAA<br>VRALNLFQGSVEDTTGSQSLAALLNKCKTPQGQRLVNQWIKQPLMDKNRIEERLNLVEAF<br>VEDAELRQTLQEDLLRRFPDLNRLAKKFQRQAANLQDCYRLYQGINQLPNVIQALEKHEG<br>KHQKLLLAVFVTPLTDLRSDFSKFQEMIETTLDMDQVENHEFLVKPSFDPNLSELREIMN<br>DLEKKMQSTLISAARDLGLDPGKQIKLDSSAQFGYYFRVTCKEEKVLRNNKNFSTVDIQK<br>NGVKFTNSKLTSLNEEYTKNKTEYEEAQDAIVKEIVNISSGYVEPMQTLNDVLAQLDAVV<br>SFAHVSNGAPVPYVRPAILEKGQGRIILKASRHACVEVQDEIAFIPNDVYFEKDKQMFHI<br>ITGPNMGGKSTYIRQTGVIVLMAQIGCFVPCESAEVSIVDCILARVGAGDSQLKGVSTFM<br>AEMLETASILRSATKDSLIIIDELGRGTSTYDGFGLAWAISEYIATKIGAFCMFATHFHE<br>LTALANQIPTVNNLHVTALTTEETLTMLYQVKKGVCDQSFGIHVAELANFPKHVIECAKQ<br>KALELEEFQYIGESQGYDIMEPAAKKCYLEREQGEKIIQEFLSKVKQMPFTEMSEENITI<br>KLKQLKAEVIAKNNSFVNEIISRIKVTT |
| MSH3 | >sp\|P20585\|MSH3_HUMAN DNA mismatch repair protein Msh3 OS = Homo sapiens GN = MSH3 PE = 1 SV = 4<br>MSRRKPASGGLAASSSAPARQAVLSRFFQSTGSLKSTSSSTGAADQVDPGAAAAAAAAAA<br>AAPPAPPAPAFPPQLPPHIATEIDRRKKRPLENDGPVKKKVKKVQQKEGGSDLGMSGNSE<br>PKKCLRTRNVSKSLEKLKEFCCDSALPQSRVQTESLQERFAVLPKCTDFDDISLLHAKNA<br>VSSEDSKRQINQKDTTLFDLSQFGSSNTSHENLQKTASKSANKRSKSIYTPLELQYIEMK<br>QQHKDAVLCVECGYKYRFFGEDAEIAARELNIYCHLDHNFMTASIPTHRLFVHVRRLVAK<br>GYKVGVVKQTETAALKAIGDNRSSLFSRKLTALYTKSTLIGEDVNPLIKLDDAVNVDEIM<br>TDTSTSYLLCISENKENVRDKKKGNIFIGIVGVQPATGEVVFDSFQDSASRSELETRMSS<br>LQPVELLLPSALSEQTEALIHRATSVSVQDDRIRVERMDNIYFEYSHAFQAVTEFYAKDT<br>VDIKGSQIISGIVNLEKPVICSLAAIIKYLKEFNLEKMLSKPENFKQLSSKMEFMTINGT<br>TLRNLEILQNQTDMKTKGSLLWVLDHTKTSFGRRKLKKWVTQPLLKLREINARLDAVSEV<br>LHSESSVFGQIENHLRKLPDIERGLCSIYHKKCSTQEFFLIVKTLYHLKSEFQAIIPAVN<br>SHIQSDLLRTVILEIPELLSPVEHYLKILNEQAAKVGDKTELFKDLSDFPLIKKRKDEIQ<br>GVIDEIRMHLQEIRKILKNPSAQYVTVSGQEFMIEIKNSAVSCIPTDWVKVGSTKAVSRF<br>HSPFIVENYRHLNQLREQLVLDCSAEWLDFLEKFSEHYHSLCKAVHHLATVDCIFSLAKV<br>AKQGDYCRPTVQEERKIVIKNGRHPVIDVLLGEQDQYVPNNTDLSEDSERVMIITGPNMG<br>GKSSYIKQVALITIMAQIGSYVPAEEATIGIVDGIFTRMGAADNIYKGQSTFMEELTDTA<br>EIIRKATSQSLVILDELGRGTSTHDGIAIAYATLEYFIRDVKSLTLFVTHYPPVCELEKN<br>YSHQVGNYHMGFLVSEDESKLDPGAAEQVPDFVTFLYQIIRGIAARSYGLNVAKLADVPG<br>EILKKAAHKSKELEGLINTKRKRLKYFAKLWIMHNAQDLQKWTEEFNMEETQTSLLH |
| MSH6 | >sp\|P52701\|MSH6_HUMAN DNA mismatch repair protein Msh6 OS = Homo sapiens GN = MSH6 PE = 1 SV = 2<br>MSRQSTLYSFFPKSPALSDANKASARASREGGRAAAAPGASPSPGGDAAWSEAGPGPRPL<br>ARSASPPKAKNLNGGLRRSVAPAAPTSCDFSPGDLVWAKMEGYPWWPCLVYNHPFDGIFI<br>REKGKSVRVHVQFFDDSPIRGWVSKRLLKPYIGSKSKEAQKGGHFYSAKPEILRAMQRAD<br>EALNKDKIKRLELAVCDEPSEPEEEEEMEVGTTYVTDKSEEDNEIESEEEVQPKTQGSRR<br>SSRQIKKRRVISDSESDIGGSDVEFKPDTKEEGSSDEISSGVGDSESEGLNSPVKVARKR<br>KRMVIGNGSLKRKSSRKETPSATKQATSISSSETKNTLRAFSAPQNSESQAHVSGGGDDSS<br>RPTVWYHETLEWLKEEKRRDEHRRRPDHPDFDASTLYVPEDFLNSCIPGMRKWWQIKSQN |

TABLE VI.15-continued

Factors involved in MMR.

| Factor | Sequence |
|---|---|
| | FDLVICYKVGKFYELYHMDALIGVSELGLVFMKGNWAHSGFPEIAFGRYSDSLVQKGYKV<br>ARVEQTETPERMEARCRKMAHISKYDRVVRREICRIITKGTQTYSVLEGDPSENYSKYLL<br>SLKEKEEDSSGHTRAYGVCFVDTSLGKFFIGQFSDDRHCSRFRILVAHYPPVQVLFEKGN<br>LSKETKTILKSSLSCSLQEEGLIPGSQFWDASKTLRILLEEEYFREKLSDGIGVMLPQVLK<br>GMTSESDSIGLIPGEKSELALSALGGCVFYLKKCLIDQELLSMANFEEYIPLDSDIVSTT<br>RSGAIFTKAYQRMVLDAVILNNLEIFLNGINGSTEGILLERVDTCHTPFGKRLLKQWLCA<br>PLCNHYAINDRLDAIEDLMVVPDKISEVVELLKKLPDLERLLSKIHNVGSPLKSQNHPDS<br>RAIMYEETTYSKKKIIDFLSALEGFKVMCKIIGIMEEVADGFKSKILKQVISLQTKNPEG<br>RFPDLIVELNRWDTAFDHEKARKTGLITPKAGFDSDYDQALADIRENEQSLLEYLEKQRN<br>RIGCRTIVYWGIGRNRYQLEIPENFTTRNLPEEYELKSIKKGCKRYWIKTIEKKLANLIN<br>AEERRDVSLKDCMRRLFYNFDKNYKDWQSAVECIAVLDVLLCLANYSRGGDGPMCRPVIL<br>LPEDIPPFLELKGSRHPCITKIFFGDDFIPNDILIGCEEEEQENGKAYCVLVTGPNMGGK<br>STLMRQAGLLAVMAQMGCYVPAEVCRLIPIDRVFIRLGASDRIMSGESTFFVELSETASI<br>LMHATAHSLVLVDELGRGTATFDGTAIANAVVKELAETIKCRTLFSTHYHSLVEDYSQNV<br>AVRLGHMACMVENECEDPSQETITFLYKFIKGACPKSYGFNAARLANLPEEVIQKGHRKA<br>REFEKMNQSLRLFREVCLASERSTVDAEAVHKLLTLIKEL |
| MLH1 | >sp\|P40692\|MLH1_HUMAN DNA mismatch repair protein Mlh1 OS = *Homo sapiens* GN = MLH1 PE = 1 SV = 1<br>MSFVAGVIRRLDETVVNRIAAGEVIQRPANAIKEMIENCLDAKSTSIQVIVKEGGLKLIQ<br>IQDNGTGIRKEDLDIVCERFTTSKLQSFEDLASISTYGFRGEALASISHVAHVTITTKTA<br>DGKCAYRASYSDGKLKAPPKPCAGNQGTQIIVEDLEYNIATRRKALKNPSEEYGKILEVV<br>GRYSVHNAGISFSVKKQGETVADVRTLPNASTVDNIRSIFGNAVSRELIEIGCEDKILAF<br>KMNGYISNANYSVKKCIFLLFINHRLVESTSLRKAIETVYAAYLPKNTHPFLYLSLEISP<br>QNVDVNVHPIKHEVHFLHEESILERVQQHIESKLLGSNSSRMYFTQTLLPGLAGPSGEMV<br>KSTISLISSSTSGSSDKVYAHQMVRIDSREQKLDAFLQPLSKPLSSQPQAIVIEDKIDIS<br>SGRARQQDEEMLELPAPAEVAAKNQSLEGDTTKGTSEMSEKRGPTSSNPRKRHREDSDVE<br>MVEDDSRKEMTAACTPRRRIINLTSVLSLQEEINEQGHEVLREMLHNHSFVGCVNPQWAL<br>AQHQTKLYLLNITKLSEELFYQILIYDFANFGVLRLSEPAPLFDLAMLALDSPESGWTEE<br>DGPKEGLAEYIVEFLKKKAEMLADYFSLEIDEEGNLIGLPLLIDNYVPPLEGLPIFILRL<br>ATEVNWDEEKECFESLSKECAMFYSIRKQYISEESTLSGQQSEVPGSIPNSWKWIVEHIV<br>YKALRSHILPPKHFTEDGNILQLANLPDLYKVFERC<br>>sp\|P40692-2\|MLH1_HUMAN Isoform 2 of DNA mismatch repair protein Mlh1 OS = *Homo sapiens* GN = MLH1<br>MNGYISNANYSVKKCIFLLFINHRLVESTSLRKAIETVYAAYLPKNTHPFLYLSLEISPQ<br>NVDVNVHPTKHEVHFLHEESILERVQQHIESKLLGSNSSRMYFTQTLLPGLAGPSGEMVK<br>STTSLTSSSTSGSSDKVYAHQMVRTDSREQKLDAFLQPLSKPLSSQPQAIVTEDKTDISS<br>GRARQQDEEMLELPAPAEVAAKNQSLEGDTTKGTSEMSEKRGPTSSNPRKRHREDSDVEM<br>VEDDSRKEMTAACTPRRRIINLTSVLSLQEEINEQGHEVLREMLHNHSFVGCVNPQWALA<br>QHQTKLYLLNTTKLSEELFYQILIYDFANFGVLRLSEPAPLFDLAMLALDSPESGWTEED<br>GPKEGLAEYIVEFLKKKAEMLADYFSLEIDEEGNLIGLPLLIDNYVPPLEGLPIFILRLA<br>TEVNWDEEKECFESLSKECAMFYSIRKQYISEESTLSGQQSEVPGSIPNSWKWTVEHIVY<br>KALRSHILPPKHFTEDGNILQLANLPDLYKVFERC<br>>sp\|P40692-3\|MLH1_HUMAN Isoform 3 of DNA mismatch repair protein Mlh1 OS = *Homo sapiens* GN = MLH1<br>MAFEALASISHVAHVTITTKTADGKCAYRASYSDGKLKAPPKPCAGNQGTQITVEDLFYN<br>IATRRKALKNPSEEYGKILEVVGRYSVHNAGISFSVKKQGETVADVRTLPNASTVDNIRS<br>IFGNAVSRELIEIGCEDKTLAFKMNGYISNANYSVKKCIFLLFINHRLVESTSLRKAIET<br>VYAAYLPKNTHPFLYLSLEISPQNVDVNVHPTKHEVHFLHEESILERVQQHIESKLLGSN<br>SSRMYFTQILLPGLAGPSGEMVKSTISLTSSSTSGSSDKVYAHQMVRIDSREQKLDAFLQ<br>PLSKPLSSQPQAIVTEDKTDISSGRARQQDEEMLELPAPAEVAAKNQSLEGDTTKGTSEM<br>SEKRGPTSSNPRKRHREDSDVEMVEDDSRKEMTAACTPRRRIINLTSVLSLQEEINEQGH<br>EVLREMLHNHSFVGCVNPQWALAQHQTKLYLLNTTKLSEELFYQILIYDFANFGVLRLSE<br>PAPLFDLAMLALDSPESGWTEEDGPKEGLAEYIVEFLKKKAEMLADYFSLEIDEEGNLIG<br>LPLLIDNYVPPLEGLPIFILRLATEVNWDEEKECFESLSKECAMFYSIRKQYISEESTLS<br>GQQSEVPGSIPNSWKWTVEHIVYKALRSHILPPKHFTEDGNILQLANLPDLYKVFERC |
| PMS2 | >sp\|P54278\|PMS2_HUMAN Mismatch repair endonuclease PMS2 OS = *Homo sapiens* GN = PMS2 PE = 1 SV = 2<br>MERAESSSTEPAKAIKPIDRKSVHQICSGQVVLSLSTAVKELVENSLDAGATNIDLKLKD<br>YGVDLIEVSDNGCGVEEENFEGLTLKHHTSKIQEFADLTQVETFGFRGEALSSLCALSDV<br>TISTCHASAKVGTRLMFDHNGKIIQKTPYPRPRGTTVSVQQLFSTLPVRHKEFQRNIKKE<br>YAKMVQVLHAYCIISAGIRVSCINQLGQGKRQPVVCIGGSPSIKENIGSVFGQKQLQSLI<br>PFVQLPPSDSVCEEYGLSCSDALHNLFYISGFISQCTHGVGRSSTDRQFFFINRRPCDPA<br>KVCRLVNEVYHMYNRHQYPFVVLNISVDSECVDINVTPDKRQILLQEEKLLLAVLKTSLI<br>GMFDSDVNKLNVSQQPLLDVEGNLIKMHAADLEKPMVEKQDQSPSLRTGEEKKDVSISRL<br>REAFSLRHTTENKPHSPKTPEPRRSPLGQKRGMLSSSTSGAISDKGVLRPQKEAVSSSHG<br>PSDPTDRAEVEKDSGHGSTSVDSEGFSIPDTGSHCSSEYAASSPGDRGSQEHVDSQEKAP<br>KTDDSFSDVDCHSNQEDTGCKFRVLPQPTNLATPNTKRFKKEEILSSSDICQKLVNTQDM<br>SASQVDVAVKINKKVVPLDFSMSSLAKRIKQLHHEAQQSEGEQNYRKFRAKICPGENQAA<br>EDELRKEISKTMFAEMETIGQFNLGFIITKLNEDIFIVDQHATDEKYNFEMLQQHTVLQG<br>QRLIAPQTLNLTAVNEAVLIENLEIFRKNGFDEVIDENAPVTERAKLISLPTSKNWTFGP<br>QDVDELIFMLSDPGVMCRPSRVKQMFASRACRKSVMIGTALNTSEMKKLITHMGEMDHP<br>WNCPHGRPTMRHIANLGVISQN |

TABLE VI.15-continued

Factors involved in MMR.

| Factor | Sequence |
|---|---|
| | >sp\|P54278-2\|PMS2_HUMAN Isoform 2 of Mismatch repair endonuclease PMS2 OS = *Homo sapiens* GN = PMS2<br>MERAESSSTEPAKAIKPIDRKSVHQICSGQVVLSLSTAVKELVENSLDAGATNIDLKLKD<br>YGVDLIEVSDNGCGVEEENFEGLTLKHHTSKIQEFADLTQVETFGFRGEALSSLCALSDV<br>TISTCHASAKVGTRLMFDHNGKIIQKTPYPRPRGTTVSVQQLFSTLPVRHKEFQRNIKKE<br>YAKMVQVLHAYCIISAGIRVSCINQLGQGKRQPVVCIGGSPSIKENIGSVFGQKQLQSLI<br>PFVQLPPSDSVCEEYGLSCSDALHNLFYKTMFAEMETIGQFNLGFIITKLNEDIFIVDQH<br>ATDEKYNFEMLQQHTVLQGQRLIAPQTLNLTAVNEAVLIENLEIFRKNGFDEVIDENAPV<br>TERAKLISLPTSKNWTFGPQDVDELIFMLSDSPGVMCRPSRVKQMFASRACRKSVMIGTA<br>LNTSEMKKLITHMGEMDHPWNCPHGRPTMRHIANLGVISQN<br>>sp\|P54278-3\|PMS2_HUMAN Isoform 3 of Mismatch repair endonuclease PMS2 OS = *Homo sapiens* GN = PMS2<br>MERAESSSTEPAKAIKPIDRKSVHQICSGQVVLSLSTAVKELVENSLDAGATNIDLKLKD<br>YGVDLIEVSDNGCGVEEENFEGLTLKHHTSKIQEFADLTQVETFGFRGEALSSLCALSDV<br>TISTCHASAKVGTRLMFDHNGKIIQKTPYPRPRGTTVSVQQLFSTLPVRHKEFQRNIKKE<br>YAKMVQVLHAYCIISAGIRVSCINQLGQGKRQPVVCIGGSPSIKENIGSVFGQKQLQSLI<br>PFVQLPPSDSVCEEYGLSCSDALHNLFYISGFISQCTHGVGRSSTDRQFFFINRRPCDPA<br>KVCRLVNEVYHMYNRHQYPFVVLNISVDSECVDINVTPDKRQILLQEEKLLLAVLKTSLI<br>GMFDSDVNKLNVSQQPLLDVEGNLIKMHAADLEKPMVEKQDQSPSLRTGEEKKDVSISRL<br>REAFSLRHTTENKPHSPKTPEPRRSPLGQKRGMLSSSTSGAISDKGVLRPQKEAVSSSHG<br>PSDPTDRAEVEKDSGHGSTSVDSEGFSIPDTGSHCSSEYAASSPGDRGSQEHVDSQEKAP<br>KTDDSFSDVDCHSNQEDTGLKTGPSDPRTSMN<br>>sp\|P54278-4\|PMS2_HUMAN Isoform 4 of Mismatch repair endonuclease PMS2 OS = *Homo sapiens* GN = PMS2<br>MERAESSSTEPAKAIKPIDRKSVHQICSGQVVLSLSTAVKELVENSLDAGATNIDLKLKD<br>YGVDLIEVSDNGCGVEEENFEGLTLKHHTSKIQEFADLTQVETFGFRGEALSSLCALSDV<br>TISTCHASAKVGTRLMFDHNGKIIQKTPYPRPRGTTVSVQQLFSTLPVRHKEFQRNIKKQ<br>ASV |
| MLH3 | >sp\|Q9UHC1\|MLH3_HUMAN DNA mismatch repair protein Mlh3 OS = *Homo sapiens* GN = MLH3 PE = 1 SV = 3<br>MIKCLSVEVQAKLRSGLAISSLGQCVEELALNSIDAEAKCVAVRVNMETFQVQVIDNGFG<br>MGSDDVEKVGNRYFTSKCHSVQDLENPRFYGFRGEALANIADMASAVEISSKKNRTMKTF<br>VKLFQSGKALKACEADVTRASAGTTVTVYNLFYQLPVRRKCMDPRLEFEKVRQRIEALSL<br>MHPSISFSLRNDVSGSMVLQLPKTKDVCSRFCQIYGLGKSQKLREISFKYKEFELSGYIS<br>SEAHYNKNMQFLFVNKRLVLRTKLHKLIDFLLRKESIICKPKNGPTSRQMNSSLRHRSTP<br>ELYGIYVINVQCQFCEYDVCMEPAKTLIEFQNWDTLLFCIQEGVKMFLKQEKLFVELSGE<br>DIKEFSEDNGFSLFDATLQKRVTSDERSNFQEACNNILDSYEMFNLQSKAVKRKTTAENV<br>NTQSSRDSEATRKNTNDAFLYIYESGGPGHSKMTEPSLQNKDSSCSESKMLEQETIVASE<br>AGENEKHKKSFLEHSSLENPCGTSLEMFLSPFQTPCHFEESGQDLEIWKESTTVNGMAAN<br>ILKNNRIQNQPKRFKDATEVGCQPLPFATTLWGVHSAQTEKEKKKESSNCGRRNVFSYGR<br>VKLCSTGFITHVVQNEKTKSTETEHSFKNYVRPGPTRAQETFGNRTRHSVETPDIKDLAS<br>TLSKESGQLPNKKNCRTNISYGLENEPTATYTMFSAFQEGSKKSQTDCILSDTSPSFPWY<br>RHVSNDSRKTDKLIGFSKPIVRKKLSLSSQLGSLEKFKRQYGKVENPLDTEVEESNGVTT<br>NLSLQVEPDILLKDKNRLENSDVCKITTMEHSDSDSSCQPASHILNSEKFPFSKDEDCLE<br>QQMPSLRESPMTLKELSLFNRKPLDLEKSSESLASKLSRLKGSERETQTMGMMSRFNELP<br>NSDSSRKDSKLCSVLTQDFCMLFNNKHEKTENGVIPTSDSATQDNSFNKNSKTHSNSNTT<br>ENCVISETPLVLPYNNSKVTGKDSDVLIRASEQQIGSLDSPSGMLMNPVEDATGDQNGIC<br>FQSEESKARACSETEESNTCCSDWQRHFDVALGRMVYVNKMTGLSTFIAPTEDIQAACTK<br>DLTTVAVDVVLENGSQYRCQPFRSDLVLPFLPRARAERTVMRQDNRDTVDDTVSSESLQS<br>LFSEWDNPVFARYPEVAVDVSSGQAESLAVKIHNILYPYRFTKGMIHSMQVLQQVDNKFI<br>ACLMSTKTEENGEAGGNLLVLVDQHAAHERIRLEQLIIDSYEKQQAQGSGRKKLLSSTLI<br>PPLEITVTEEQRRLLWCYHKNLEDLGLEFVFPDTSDSLVLVGKVPLCFVEREANELRRGR<br>STVTKSIVEEFIREQLELLQTTGGIQGTLPLTVQKVLASQACHGAIKFNDGLSLQESCRL<br>IEALSSCQLPFQCAHGRPSMLPLADIDHLEQEKQIKPNLTKLRKMAQAWRLFGKAECDTR<br>QSLQQSMPPCEPP<br>>sp\|Q9UHC1-2\|MLH3_HUMAN Isoform 2 of DNA mismatch repair protein Mlh3 OS = *Homo sapiens* GN = MLH3<br>MIKCLSVEVQAKLRSGLAISSLGQCVEELALNSIDAEAKCVAVRVNMETFQVQVIDNGFG<br>MGSDDVEKVGNRYFTSKCHSVQDLENPRFYGFRGEALANIADMASAVEISSKKNRTMKTF<br>VKLFQSGKALKACEADVTRASAGTTVTVYNLFYQLPVRRKCMDPRLEFEKVRQRIEALSL<br>MHPSISFSLRNDVSGSMVLQLPKTKDVCSRFCQIYGLGKSQKLREISFKYKEFELSGYIS<br>SEAHYNKNMQFLFVNKRLVLRTKLHKLIDFLLRKESIICKPKNGPTSRQMNSSLRHRSTP<br>ELYGIYVINVQCQFCEYDVCMEPAKTLIEFQNWDTLLFCIQEGVKMFLKQEKLFVELSGE<br>DIKEFSEDNGFSLFDATLQKRVTSDERSNFQEACNNILDSYEMFNLQSKAVKRKTTAENV<br>NTQSSRDSEATRKNTNDAFLYIYESGGPGHSKMTEPSLQNKDSSCSESKMLEQETIVASE<br>AGENEKHKKSFLEHSSLENPCGTSLEMFLSPFQTPCHFEESGQDLEIWKESTTVNGMAAN<br>ILKNNRIQNQPKRFKDATEVGCQPLPFATTLWGVHSAQTEKEKKKESSNCGRRNVFSYGR<br>VKLCSTGFITHVVQNEKTKSTETEHSFKNYVRPGPTRAQETFGNRTRHSVETPDIKDLAS<br>TLSKESGQLPNKKNCRTNISYGLENEPTATYTMFSAFQEGSKKSQTDCILSDTSPSFPWY<br>RHVSNDSRKTDKLIGFSKPIVRKKLSLSSQLGSLEKFKRQYGKVENPLDTEVEESNGVTT<br>NLSLQVEPDILLKDKNRLENSDVCKITTMEHSDSDSSCQPASHILNSEKFPFSKDEDCLE<br>QQMPSLRESPMTLKELSLFNRKPLDLEKSSESLASKLSRLKGSERETQTMGMMSRFNELP<br>NSDSSRKDSKLCSVLTQDFCMLFNNKHEKTENGVIPTSDSATQDNSFNKNSKTHSNSNTT<br>ENCVISETPLVLPYNNSKVTGKDSDVLIRASEQQIGSLDSPSGMLMNPVEDATGDQNGIC<br>FQSEESKARACSETEESNTCCSDWQRHFDVALGRMVYVNKMTGLSTFIAPTEDIQAACTK |

TABLE VI.15-continued

Factors involved in MMR.

| Factor | Sequence |
|---|---|
| | DLTTVAVDVVLENGSQYRCQPFRSDLVLPFLPRARAERTVMRQDNRDTVDDTVSSESLQS<br>LFSEWDNPVFARYPEVAVDVSSGQAESLAVKIHNILYPYRFTKGMIHSMQVLQQVDNKFI<br>ACLMSTKTEENGEADSYEKQQAQGSGRKKLLSSTLIPPLEITVTEEQRRLLWCYHKNLED<br>LGLEFVFPDTSDSLVLVGKVPLCFVEREANELRRGRSTVTKSIVEEFIREQLELLQTTGG<br>IQGTLPLTVQKVLASQACHGAIKFNDGLSLQESCRLIEALSSCQLPFQCAHGRPSMLPLA<br>DIDHLEQEKQIKPNLTKLRKMAQAWRLFGKAECDTRQSLQQSMPPCEPP |
| DNA Polymerase delta | See Table VI.13 |
| RPA | — |
| HMGB1 | >sp\|P09429\|HMGB1_HUMAN High mobility group protein B1 OS = *Homo sapiens* GN = HMGB1 PE = 1 SV = 3<br>MGKGDPKKPRGKMSSYAFFVQTCREEHKKKHPDASVNFSEFSKKCSERWKTMSAKEKGKF<br>EDMAKADKARYEREMKTYIPPKGETKKKFKDPNAPKRPPSAFFLFCSEYRPKIKGEHPGL<br>SIGDVAKKLGEMWNNTAADDKQPYEKKAAKLKEKYEKDIAAYRAKGKPDAAKKGVVKAEK<br>SKKKKEEEEDEEDEEDEEEEEDEEDEDEEEDDDDE<br>>tr\|Q5T7C4\|Q5T7C4_HUMAN High mobility group protein B1 OS = *Homo sapiens* GN = HMGB1 PE = 1 SV = 1<br>MGKGDPKKPRGKMSSYAFFVQTCREEHKKKHPDASVNFSEFSKKCSERWKTMSAKEKGKF<br>EDMAKADKARYEREMKTYIPPKGETKKKFKDPNAPKRPPSAFFLFCSEYRPKIKGEHPGL<br>SIGDVAKKLGEMWNNTAADDKQPYEKKAAKLKEKYEKF |
| RFC | >sp\|P35251\|RFC1_HUMAN Replication factor C subunit 1 OS = *Homo sapiens* GN = RFC1 PE = 1 SV = 4<br>MDIRKFFGVIPSGKKLVSETVKKNEKTKSDEETLKAKKGIKEIKVNSSRKEDDFKQKQPS<br>KKKRITYDSDSESEETLQVKNAKKPPEKLPVSSKPGKISRQDPVTYISETDEEDDFMCKK<br>AASKSKENGRSTNSHLGTSNMKKNEENTKTKNKPLSPIKLTPTSVLDYFGTGSVQRSNKK<br>MVASKRKELSQNTDESGLNDEATAKQLQLDEDAELERQLHEDEEFARTLAMLDEEPKTKK<br>ARKDTEAGETFSSVQANLSKAEKHKYPHKVKTAQVSDERKSYSPRKQSKYESSKESQQHS<br>KSSADKIGEVSSPKASSKLAIMKRKEESSYKEIEPVASKRKENAIKLKGETKTPKKTKSS<br>PAKKESVSPEDSEKKRTNYQAYRSYLNREGPKALGSKEIPKGAENCLEGLIFVITGVLES<br>IERDEAKSLIERYGGKVTGNVSKKTNYLVMGRDSGQSKSDKAAALGTKIIDEDGLLNLIR<br>TMPGKKSKYEIAVETEMKKESKLERTPQKNVQGKRKISPSKKESESKKSRPTSKRDSLAK<br>TIKKETDVFWKSLDFKEQVAEETSGDSKARNLADDSSENKVENLLWVDKYKPTSLKTIIG<br>QQGDQSCANKLLRWLRNWQKSSSEDKKHAAKFGKFSGKDDGSSFKAALLSGPPGVGKTTT<br>ASLVCQELGYSYVELNASDTRSKSSLKAIVAESLNNTSIKGFYSNGAASSVSTKHALIMD<br>EVDGMAGNEDRGGIQELIGLIKHTKIPIICMCNDRNHPKIRSLVHYCFDLRFQRPRVEQI<br>KGAMMSIAFKEGLKIPPPAMNEHILGANQDIRQVLHNLSMWCARSKALTYDQAKADSHRA<br>KKDIKMGPFDVARKVFAAGEETAHMSLVDKSDLFFHDYSIAPLFVQENYIHVKPVAAGGD<br>MKKHLMLLSRAADSICDGDLVDSQIRSKQNWSLLPAQAIYASVLPGELMRGYMTQFPTFP<br>SWLGKHSSTGKHDRIVQDLALHMSLRTYSSKRTVNMDYLSLLRDALVQPLTSQGVDGVQD<br>VVALMDTYYLMKEDFENIMEISSWGGKPSPFSKLDPKVKAAFTRAYNKEAHLTPYSLQAI<br>KASRHSTSPSLDSEYNEELNEDDSQSDEKDQDAIETDAMIKKKTKSSKPSKPEKDKEPRK<br>GKGKSSKK<br>>sp\|P35251-2\|RFC1_HUMAN Isoform 2 of Replication factor C subunit 1 OS = *Homo sapiens* GN = RFC1<br>MDIRKFFGVIPSGKKLVSETVKKNEKTKSDEETLKAKKGIKEIKVNSSRKEDDFKQKQPS<br>KKKRIIYDSDSESEETLQVKNAKKPPEKLPVSSKPGKISRQDPVIYISETDEEDDFMCKK<br>AASKSKENGRSINSHLGTSNMKKNEENTKIKNKPLSPIKLIPTSVLDYFGIGSVQRSNKK<br>MVASKRKELSQNTDESGLNDEAIAKQLQLDEDAELERQLHEDEEFARTLAMLDEEPKIKK<br>ARKDTEAGETFSSVQANLSKAEKHKYPHKVKTAQVSDERKSYSPRKQSKYESSKESQQHS<br>KSSADKIGEVSSPKASSKLAIMKRKEESSYKEIEPVASKRKENAIKLKGETKIPKKIKSS<br>PAKKESVSPEDSEKKRTNYQAYRSYLNREGPKALGSKEIPKGAENCLEGLIFVITGVLES<br>IERDEAKSLIERYGGKVIGNVSKKTNYLVMGRDSGQSKSDKAAALGTKIIDEDGLLNLIR<br>IMPGKKSKYEIAVETEMKKESKLERTPQKNVQGKRKISPSKKESESKKSRPTSKRDSLAK<br>TIKKETDVFWKSLDFKEQVAEETSGDSKARNLADDSSENKVENLLWVDKYKPISLKTIIG<br>QQGDQSCANKLLRWLRNWQKSSSEDKKHAKFGKFSGKDDGSSFKAALLSGPPGVGKTTTA<br>SLVCQELGYSYVELNASDIRSKSSLKAIVAESLNNTSIKGFYSNGAASSVSTKHALIMDE<br>VDGMAGNEDRGGIQELIGLIKHTKIPIICMCNDRNHPKIRSLVHYCFDLRFQRPRVEQIK<br>GAMMSIAFKEGLKIPPPAMNEIILGANQDIRQVLHNLSMWCARSKALTYDQAKADSHRAK<br>KDIKMGPFDVARKVFAAGEETAHMSLVDKSDLFFHDYSIAPLFVQENYIHVKPVAAGGDM<br>KKHLMLLSRAADSICDGDLVDSQIRSKQNWSLLPAQAIYASVLPGELMRGYMTQFPTFPS<br>WLGKHSSIGKHDRIVQDLALHMSLRTYSSKRIVNMDYLSLLRDALVQPLISQGVDGVQDV<br>VALMDTYYLMKEDFENIMEISSWGGKPSPFSKLDPKVKAAFTRAYNKEAHLTPYSLQAIK<br>ASRHSTSPSLDSEYNEELNEDDSQSDEKDQDAIETDAMIKKKIKSSKPSKPEKDKEPRKG<br>KGKSSKK |
| DNA ligase I | VI.9 |

More specifically, in some embodiments, the down-regulator of the MMR pathway may be an inhibitor of (e.g., an siRNA against) one or more factors of Table VI.15, a down-regulator listed in Table VI.16, or any combination thereof. Inhibitors of some of the proteins of Table VI.15 above are listed elsewhere in this specification.

TABLE VI.16

| Down-regulators of MMR | |
|---|---|
| 1. Msh2 | |
| siRNA | Commercially available from Dharmacon or Ambion |
| 2. Msh3 | |
| siRNA | Commercially available from Dharmacon or Ambion |
| 3. Msh6 | |
| siRNA | Commercially available from Dharmacon or Ambion |
| 4. Mlh1 | |
| siRNA | Commercially available from Dharmacon or Ambion |
| 5. Pms2 | |
| siRNA | Commercially available from Dharmacon or Ambion |
| 6. Compounds that down-regulate MMR | |
| Cadmium ($Cd^{2+}$) | |

VI.8 Base Excision Repair (BER)

The base excision repair (BER) pathway is active throughout the cell cycle; it is responsible primarily for removing small, non-helix-distorting base lesions from the genome. In contrast, the related Nucleotide Excision Repair (NER) pathway (discussed below) repairs bulky helix-distorting lesions (see, e.g., Caldecott (2008) NAT. REV. GENET. 9: 619-31. A brief description of the BER is provided below.

Upon DNA base damage, BER is initiated and the process can be simplified into five major steps: (a) removal of the damaged DNA base; (b) incision of the subsequent a basic site; (c) clean-up of the DNA ends; (d) insertion of the correct nucleotide into the repair gap; and (e) ligation of the remaining nick in the DNA backbone. These last steps are similar to the SSBR pathway.

In the first step, a damage-specific DNA glycosylase excises the damaged base through cleavage of the N-glycosidic bond linking the base to the sugar phosphate backbone. Then AP endonuclease-1 (APE1) or bifunctional DNA glycosylases with an associated lyase activity incise the phosphodiester backbone to create a DNA single strand break (SSB). The third step of BER involves procession (i.e., cleaning-up) of the DNA ends. The fourth step in BER is conducted by DNA polymerase beta (Pol beta) which adds a new complementary nucleotide to the repair gap. In the final step, XRCC1/Ligase III seal the remaining nick in the DNA backbone. This completes the short-patch BER pathway through which the majority (~80%) of damaged DNA bases are repaired. However, if the 5'-ends in step 3 are resistant to end-processing activity, following one nucleotide insertion by DNA polymerase beta, a polymerase switch to the replicative DNA polymerases delta/epsilon occurs, which then add ~2-8 more nucleotides into the DNA repair gap. This creates a 5'-flap structure, which is recognized and excised by flap endonuclease-1 (FEN-1) in association with the processivity factor proliferating cell nuclear antigen (PCNA). DNA ligase I then seals the remaining nick in the DNA backbone and completes long-patch BER. Additional factors are listed in Table VI.17.

In some embodiments, the methods described herein involve down-regulating the BER pathway in order to promote HDR (e.g., HR, alt-HR or SSA). For instance, in some embodiments, the methods may involve modulating, e.g., inhibiting, a component (e.g., exactly one component, or one or more components, e.g., two or three components) of the BER pathway, e.g., a component of Table VI.17. More specifically, in some embodiments, the methods may involve modulating, e.g., inhibiting, exactly one of, or one or more of DNA glycosylase, APE1, Pol beta, Pol delta, Pol epsilon, XRCC1, Ligase III, FEN-1, PCNA, RECQL4, WRN, MYH, PNKP, and APTX. Up-regulation of HDR, in some embodiments, is achieved using siRNA directed against one or more of the components listed in Table VI.17. In some embodiments, a BER pathway is down regulated using an HDR-enhancing gRNA that targets a component of a BER pathway, e.g., one or more of the components listed in Table VI.17 (e.g., one or more of DNA glycosylase, APE1, Pol beta, Pol delta, Pol epsilon, XRCC1, Ligase III, FEN-1, PCNA, RECQL4, WRN, MYH, PNKP, and APTX). In some embodiments, the HDR-enhancing gRNA is used in combination with an eiCas9 molecule. In some embodiments, the HDR-enhancing gRNA is used in combination with an eaCas9 molecule. In some embodiments, the HDR-enhancing gRNA is administered to the cell as a HDR-enhancing gRNA:Cas9 molecule complex.

In some embodiments, one or more of HDR, alt-HR, anti-HR, NHEJ, MMEJ, SSA, SSBR, NER, and MMR are not substantially down-regulated, e.g., in some embodiments the only DNA damage repair pathway to be substantially down-regulated is the BER pathway.

TABLE VI.17

Factors Involved in BER

| Factor | Sequence |
|---|---|
| DNA glycosylase | — |
| APE1 | See Table VI.13 |
| Pol beta | See Table VI.13 |
| Pol delta | See Table VI.13 |
| Pol epsilon | See Table VI.13 |
| XRCC1 | See Table VI.13 |
| Ligase III | See Table VI.9 |

TABLE VI.17-continued

Factors Involved in BER

| Factor | Sequence |
|---|---|
| FEN-1 | See Table VI.2 |
| PCNA | See Table VI.13 |
| RECQL4 | MERLRDVRERLQAWERAFRRQRGRRPSQDDVEAAPEETRALYREYRTLKRTTGQAGGGLR<br>SSESLPAAAEEAPEPRCWGPHLNRAATKSPQSTPGRSRQGSVPDYGQRLKANLKGTLQAG<br>PALGRRPWPLGRASSKASTPKPPGTGPVPSFAEKVSDEPPQLPEPQPRPGRLQHLQASLS<br>QRLGSLDPGWLQRCHSEVPDFLGAPKACRPDLGSEESQLLIPGESAVLGPGAGSQGPEAS<br>AFQEVSIRVGSPQPSSSGGEKRRWNEEPWESPAQVQQESSQAGPPSEGAGAVAVEEDPPG<br>EPVQAQPPQPCSSPSNPRYHGLSPSSQARAGKAEGTAPLHIFPRLARHDRGNYVRLNMKQ<br>KHYVRGRALRSRLLRKQAWKQKWRKKGECFGGGGATVTTKESCFLNEQFDHWAAQCPRPA<br>SEEDTDAVGPEPLVPSPQPVPEVPSLDPTVLPLYSLGPSGQLAETPAEVFQALEQLGHQA<br>FRPGQERAVMRILSGISTLLVLPTGAGKSLCYQLPALLYSRRSPCLTLVVSPLLSLMDDQ<br>VSGLPPCLKAACIHSGMTRKQRESVLQKIRAAQVHVLMLTPEALVGAGGLPPAAQLPPVA<br>FACIDEAHCLSQWSHNFRPCYLRVCKVLRERMGVHCFLGLTATATRRTASDVAQHLAVAE<br>EPDLHGPAPVPTNLHLSVSMDRDTDQALLTLLQGKRFQNLDSIIIYCNRREDTERIAALL<br>RTCLHAAWVPGSGGRAPKTTAEAYHAGMCSRERRRVQRAFMQGQLRVVVATVAFGMGLDR<br>PDVRAVLHLGLPPSFESYVQAVGRAGRDGQPAHCHLFLQPQGEDLRELRRHVHADSTDFL<br>AVKRLVQRVFPACTCTCTRPPSEQEGAVGGERPVPKYPPQEAEQLSHQAAPGPRRVCMGH<br>ERALPIQLTVQALDMPEEAIETLLCYLELHPHHWLELLATTYTHCRLNCPGGPAQLQALA<br>HRCPPLAVCLAQQLPEDPGQGSSSVEFDMVKLVDSMGWELASVRRALCQLQWDHEPRTGV<br>RRGTGVLVEFSELAFHLRSPGDLTAEEKDQICDFLYGRVQARERQALARLRRTFQAFHSV<br>AFPSCGPCLEQQDEERSTRLKDLLGRYFEEEEGQEPGGMEDAQGFEPGQARLQDWEDQVR<br>CDIRQFLSLRPEEKFSSRAVARIFHGIGSPCYPAQVYGQDRRFWRKYLHLSFHALVGLAT<br>EELLQVAR (RECQL4 CCDS 75804.1) |
| WRN | See Table VI.2 |
| MYH | MTPLVSRLSRLWAIMRKPRAAVGSGHRKQAASQEGRQKHAKNNSQAKPSACDGLARQPEEVVLQASVSSY<br>HLFRDVAEVTAFRGSLLSWYDQEKRDLPWRRRAEDEMDLDRRAYAVWVSEVMLQQTQVATVINYYTGWMQ<br>KWPTLQDLASASLEEVNQLWAGLGYYSRGRRLQEGARKVVEELGGHMPRTAETLQQLLPGVGRYTAGAIA<br>SIAFGQATGVVDGNVARVLCRVRAIGADPSSTLVSQQLWGLAQQLVDPARPGDFNQAAMELGATVCTPQR<br>PLCSQCPVESLCRARQRVEQEQLLASGSLSGSPDVEECAPNTGQCHLCLPPSEPWDQTLGVVNFPRKASR<br>KPPREESSATCVLEQPGALGAQILLVQRPNSGLLAGLWEFPSVTWEPSEQLQRKALLQELQRWAGPLPAT<br>HLRHLGEVVHTFSHIKLTYQVYGLALEGQTPVTTVPPGARWLTQEEFHTAAVSTAMKKVFRVYQGQQPGT<br>CMGSKRSQVSSPCSRKKPRMGQQVLDNFFRSHISTDAHSLNSAAQ (MYH sequence 1)<br>MRKPRAAVGSGHRKQAASQEGRQKHAKNNSQAKPSACDAGLARQPEEVVLQASVSSYHLFRDVAEVTAFR<br>GSLLSWYDQEKRDLPWRRRAEDEMDLDRRAYAVWVSEVMLQQTQVATVINYYTGWMQKWPTLQDLASASL<br>EEVNQLWAGLGYYSRGRRLQEGARKVVEELGGHMPRTAETLQQLLPGVGRYTAGAIASIAFGQATGVVDG<br>NVARVLCRVRAIGADPSSTLVSQQLWGLAQQLVDPARPGDFNQAAMELGATVCTPQRPLCSQCPVESLCR<br>ARQRVEQEQLLASGSLSGSPDVEECAPNTGQCHLCLPPSEPWDQTLGVVNFPRKASRKPPREESSATCVL<br>EQPGALGAQILLVQRPNSGLLAGLWEEPSVTWEPSEQLQRKALLQELQRWAGPLPATHLRHLGEVVHTFS<br>HIKLTYQVYGLALEGQTPVTTVPPGARWLTQEEFHTAAVSTAMKKVFRVYQGQQPGTCMGSKRSQVSSPC<br>SRKKPRMGQQVLDNFFRSHISTDAHSLNSAAQ (MYH sequence 2)<br>MRKPRAAVGSGHRKQAASQEGRQKHAKNNSQAKPSACDGLARQPEEVVLQASVSSYHLFRDVAEVTAFRG<br>SLLSWYDQEKRDLPWRRRAEDEMDLDRRAYAVWVSEVMLQQTQVATVINYYTGWMQKWPTLQDLASASLE<br>EVNQLWAGLGYYSRGRRLQEGARKVVEELGGHMPRTAETLQQLLPGVGRYTAGAIASIAFGQATGVVDGN<br>VARVLCRVRAIGADPSSTLVSQQLWGLAQQLVDPARPGDFNQAAMELGATVCTPQRPLCSQCPVESLCRA<br>RQRVEQEQLLASGSLSGSPDVEECAPNTGQCHLCLPPSEPWDQTLGVVNFPRKASRKPPREESSATCVLE<br>QPGALGAQILLVQRPNSGLLAGLWEFPSVTWEPSEQLQRKALLQELQRWAGPLPATHLRHLGEVVHTFSH<br>IKLTYQVYGLALEGQTPVTTVPPGARWLTQEEFHTAAVSTAMKKVFRVYQGQQPGTCMGSKRSQVSSPCS<br>RKKPRMGQQVLDNFFRSHISTDAHSLNSAAQ (MYH sequence 3)<br>MTPLVSRLSRLWAIMRKPRAAVGSGHRKQAASQEGRQKHAKNNSQAKPSACDAGLARQPEEVVLQASVSS<br>YHLFRDVAEVTAFRGSLLSWYDQEKRDLPWRRRAEDEMDLDRRAYAVWVSEVMLQQTQVATVINYYTGWM<br>QKWPTLQDLASASLEEVNQLWAGLGYYSRGRRLQEGARKVVEELGGHMPRTAETLQQLLPGVGRYTAGAI<br>ASIAFGQATGVVDGNVARVLCRVRAIGADPSSTLVSQQLWGLAQQLVDPARPGDFNQAAMELGATVCTPQ<br>RPLCSQCPVESLCRARQRVEQEQLLASGSLSGSPDVEECAPNTGQCHLCLPPSEPWDQTLGVVNFPRKAS<br>RKPPREESSATCVLEQPGALGAQILLVQRPNSGLLAGLWEFPSVTWEPSEQLQRKALLQELQRWAGPLPA<br>THLRHLGEVVHTFSHIKLTYQVYGLALEGQTPVTTVPPGARWLTQEEFHTAAVSTAMKKVFRVYQGQQPG<br>TCMGSKRSQVSSPCSRKKPRMGQQVLDNFFRSHISTDAHSLNSAAQ (MYH sequence 4) |
| PNKP | See Table VI.7 |
| APTX | See Table VI.13 |

More specifically, in some embodiments, the down-regulator of the BER pathway may be an inhibitor of (e.g., an siRNA against) one or more factors of Table VI.17, or any combination thereof. Inhibitors of some of the proteins of Table VI.17 above are listed elsewhere in this specification.

VI.9 Nucleotide Excision Repair (NER)

The nucleotide excision repair (NER) pathway is an important excision mechanism that removes bulky helix-distorting lesions from DNA (see, e.g., Marteijn et al. (2014) NAT. REV. MOL. CELL BIOL. 15: 465-481). A brief description of NER is provided below.

NER a broad pathway encompassing two smaller pathways: global genomic NER (GG-NER) and transcription coupled repair NER (TC-NER). GG-NER and TC-NER use different factors for recognizing DNA damage. However, they utilize the same machinery for lesion incision, repair, and ligation.

Once damage is recognized, the cell removes a short single-stranded DNA segment that contains the lesion. Endonucleases XPF/ERCC1 and XPG (encoded by ERCC5) remove the lesion by cutting the damaged strand on either side of the lesion, resulting in a single-strand gap of 22-30 nucleotides. Next, the cell performs DNA gap filling synthesis and ligation. Involved in this process are: PCNA; RFC; DNA polymerase delta, DNA polymerase epsilon (Pol epsilon) and/or DNA Polymerase kappa (Pol kappa); and DNA ligase I and/or XRCC1/Ligase III. Replicating cells tend to use DNA polymerase epsilon and DNA ligase I, while non-replicating cells tend to use DNA polymerase delta, DNA polymerase kappa, and the XRCC1/Ligase III complex to perform the ligation step.

NER can involve one or more of the following factors: XPA-G, POLH, XPF, ERCC1, and LIG1. Transcription-coupled NER (TC-NER) can involve one or more of the following factors: CSA, CSB, XPB, XPD, XPG, ERCC1, and TTDA. Additional factors are shown in Table VI.18.

In some embodiments, the methods described herein involve down-regulating the NER pathway in order to promote HDR (e.g., HR, alt-HR or SSA). For instance, in some embodiments, the methods may involve modulating, e.g., inhibiting, a component (e.g., exactly one component, or one or more components, e.g., two or three components) of the NER pathway, e.g., a component of Table VI.18. More specifically, in some embodiments, the methods may involve modulating, e.g., inhibiting, exactly one of, or one or more of XPA-G, POLH, XPF, ERCC1, LIG1, CSA, CSB, XPA, XPB, XPC, XPD, XPF, XPG, ERCC1, TTDA, UVSSA, USP7, CETN2, RAD23B, UV-DDB, CAK subcomplex, RPA, and PCNA. Up-regulation of HDR, in some embodiments, is achieved using siRNA directed against one or more of the components listed in Table VI.1. In some embodiments, a NER pathway is down regulated using an HDR-enhancing gRNA that targets a component of a NER pathway, e.g., one or more of the components listed in Table VI.18 (e.g., one or more of XPA-G, POLH, XPF, ERCC1, LIG1, CSA, CSB, XPA, XPB, XPC, XPD, XPF, XPG, ERCC1, TTDA, UVSSA, USP7, CETN2, RAD23B, UV-DDB, CAK subcomplex, RPA, and PCNA). In some embodiments, the HDR-enhancing gRNA is used in combination with an eiCas9 molecule. In some embodiments, the HDR-enhancing gRNA is used in combination with an eaCas9 molecule. In some embodiments, the HDR-enhancing gRNA is administered to the cell as a HDR-enhancing gRNA:Cas9 molecule complex.

In some embodiments, one or more of HDR, alt-HR, anti-HR, NHEJ, MMEJ, SSA, SSBR, BER, and MMR are not substantially down-regulated, e.g., in some embodiments the only DNA damage repair pathway to be substantially down-regulated is the NER pathway.

TABLE VI.18

Factors Involved in NER.

| Factor | Sequence |
|---|---|
| XPA-G | — |
| POLH | >sp\|Q9Y253\|POLH_HUMAN DNA polymerase eta OS = Homo sapiens GN = POLH PE = 1 SV = 1<br>MATGQDRVVALVDMDCFFVQVEQRQNPHLRNKPCAVVQYKSWKGGGIIAVSYEARAFGVT<br>RSMWADDAKKLCPDLLLAQVRESRGKANLTKYREASVEVMEIMSRFAVIERASIDEAYVD<br>LTSAVQERLQKLQGQPISADLLPSTYIEGLPQGPTTAEETVQKEGMRKQGLFQWLDSLQI<br>DNLTSPDLQLTVGAVIVEEMRAAIERETGFQCSAGISHNKVLAKLACGLNKPNRQTLVSH<br>GSVPQLFSQMPIRKIRSLGGKLGASVIEILGIEYMGELTQFTESQLQSHFGEKNGSWLYA<br>MCRGIEHDPVKPRQLPKTIGCSKNFPGKTALATREQVQWWLLQLAQELEERLTKDRNDND<br>RVATQLVVSIRVQGDKRLSSLRRCCALTRYDAHKMSHDAFTVIKNCNTSGIQTEWSPPLT<br>MLFLCATKFSASAPSSSTDITSFLSSDPSSLPKVPVTSSEAKTQGSGPAVTATKKATTSL<br>ESFFQKAAERQKVKEASLSSLTAPTQAPMSNSPSKPSLPFQTSQSTGTEPFFKQKSLLLK<br>QKQLNNSSVSSPQQNPWSNCKALPNSLPTEYPGCVPVCEGVSKLEESSKATPAEMDLAHN<br>SQSMHASSASKSVLEVTQKATPNPSLLAAEDQVPCEKCGSLVPVWDMPEHMDYHFALELQ<br>KSFLQPHSSNPQVVSAVSHQGKRNPKSPLACTNKRPRPEGMQTLESFFKPLTH<br>>sp\|Q9Y253-2\|POLH_HUMAN Isoform 2 of DNA polymerase eta OS = Homo sapiens GN = POLH<br>MATGQDRVVALVDMDCFFVQVEQRQNPHLRNKPCAVVQYKSWKGGGIIAVSYEARAFGVT<br>RSMWADDAKKLCPDLLLAQVRESRGKANLTKYREASVEVMEIMSRFAVIERASIDEAYVD<br>LTSAVQERLQKLQGQPISADLLPSTYIEGLPQGPTTAEETVQKEGMRKQGLFQWLDSLQI<br>DNLTSPDLQLTVGAVIVEEMRAAIERETGFQCSAGISHNKVLAKLACGLNKPNRQTLVSH<br>GSVPQLFSQMPIRKIRSLGGKLGASVIEILGIEYMGELTQFTESQLQSHFGEKNGSWLYA<br>MCRGIEHDPVKPRQLPKTIGCSKNFPGKTALATREQVQWWLLQLAQELEERLTKDRNDND<br>RVATQLVVSIRVQGDKRLSSLRRCCALTRYDAHKMSHDAFTVIKNCNTSGIQTE |
| XPF | See Table VI.9 |
| ERCC1 | See Table VI.9 |
| LIG1 | See Table VI.9 |

TABLE VI.18-continued

Factors Involved in NER.

| Factor | Sequence |
|---|---|
| CSA (also called ERCC8) | >sp|Q13216|ERCC8_HUMAN DNA excision repair protein ERCC-8 OS = Homo sapiens GN = ERCC8 PE = 1 SV = 1<br>MLGFLSARQTGLEDPLRLRRAESTRRVLGLELNKDRDVERIHGGGINTLDIEPVEGRYML<br>SGGSDGVIVLYDLENSSRQSYYTCKAVCSIGRDHPDVHRYSVETVQWYPHDTGMFTSSSF<br>DKTLKVWDTNTLQTADVFNFEETVYSHHMSPVSTKHCLVAVGTRGPKVQLCDLKSGSCSH<br>ILQGHRQEILAVSWSPRYDYILATASADSRVKLWDVRRASGCLITLDQHNGKKSQAVESA<br>NTAHNGKVNGLCFTSDGLHLLTVGTDNRMRLWNSSNGENTLVNYGKVCNNSKKGLKFTVS<br>CGCSSEFVFVPYGSTIAVYTVYSGEQITMLKGHYKTVDCCVFQSNFQELYSGSRDCNILA<br>WVPSLYEPVPDDDETTTKSQLNPAFEDAWSSSDEEG<br>>sp|Q13216-2|ERCC8_HUMAN Isoform 2 of DNA excision repair protein ERCC-8 OS = Homo sapiens GN = ERCC8<br>MLGFLSARQTGLEDPLRLRRAESTRRVLGLELNKDRDVERIHGGGINTLDIEPVEGRYML<br>SGGSDGVIVLYDLENSSRQSYYTCKAVCSIGRDHPDVHRYSVETVQWYPHDTGMFTSSSF<br>DKTLKVWDTNTLQTADVFNFEETVYSHHMSPVSTKHCLVAVGTRGPKVQLCDLKSGSCSH<br>ILQGIFILFQTATTLSKRFNKKKRY |
| CSB (also called ERCC6) | >sp|Q03468|ERCC6_HUMAN DNA excision repair protein ERCC-6 OS = Homo sapiens GN = ERCC6 PE = 1 SV = 1<br>MPNEGIPHSSQTQEQDCLQSQPVSNNEEMAIKQESGGDGEVEEYLSFRSVGDGLSTSAVG<br>CASAAPRRGPALLHIDRHQIQAVEPSAQALELQGLGVDVYDQDVLEQGVLQQVDNAIHEA<br>SRASQLVDVEKEYRSVLDDLTSCTTSLRQINKIIEQLSPQAATSRDINRKLDSVKRQKYN<br>KEQQLKKITAKQKHLQAILGGAEVKIELDHASLEEDAEPGPSSLGSMLMPVQETAWEELI<br>RTGQMTPFGTQIPQKQEKKPRKIMLNEASGFEKYLADQAKLSFERKKQGCNKRAARKAPA<br>PVTPPAPVQNKNKPNKKARVLSKKEERLKKHIKKLQKRALQFQGKVGLPKARRPWESDMR<br>PEAEGDSEGEESEYFPTEEEEEEEDDEVEGAEADLSGDGTDYELKPLPKGGKRQKKVPVQ<br>EIDDDFFPSSGEEAEAASVGEGGGGGRKVGRYRDDGDEDYYKQRLRRWNKLRLQDKEKRL<br>KLEDDSEESDAEFDEGFKVPGFLFKKLFKYQQTGVRWLWELHCQQAGGILGDEMGLGKTI<br>QIIAFLAGLSYSKIRTRGSNYRFEGLGPTVIVCPTTVMHQWVKEFHTWWPPFRVAILHET<br>GSYTHKKEKLIRDVAHCHGILITSYSYIRLMQDDISRYDWHYVILDEGHKIRNPNAAVTL<br>ACKQFRTPHRIILSGSPMQNNLRELWSLFDFIFPGKLGTLPVFMEQFSVPITMGGYSNAS<br>PVQVKTAYKCACVLRDTINPYLLRRMKSDVKMSLSLPDKNEQVLFCRLTDEQHKVYQNFV<br>DSKEVYRILNGEMQIFSGLIALRKICNHPDLFSGGPKNLKGLPDDELEEDQFGYWKRSGK<br>MIVVESLLKIWHKQGQRVLLFSQSRQMLDILEVFLRAQKYTYLKMDGTTTIASRQPLITR<br>YNEDTSIFVFLLTTRVGGLGVNLTGANRVVIYDPDWNPSTDTQARERAWRIGQKKQVTVY<br>RLLTAGTIEEKIYHRQIFKQFLTNRVLKDPKQRRFFKSNDLYELFTLTSPDASQSTETSA<br>IFAGTGSDVQTPKCHLKRRIQPAFGADHDVPKRKKFPASNISVNDATSSEEKSEAKGAEV<br>NAVTSNRSDPLKDDPHMSSNVTSNDRLGEETNAVSGPEELSVISGNGECSNSSGTGKTSM<br>PSGDESIDEKLGLSYKRERPSQAQTEAFWENKQMENNFYKHKSKTKHHSVAEEETLEKHL<br>RPKQKPKNSKHCRDAKFEGTRIPHLVKKRRYQKQDSENKSEAKEQSNDDYVLEKLFKKSV<br>GVHSVMKHDAIMDGASPDYVLVEAEANRVAQDALKALRLSRQRCLGAVSGVPTWTGHRGI<br>SGAPAGKKSRFGKKRNSNFSVQHPSSTSPTEKCQDGIMKKEGKDNVPEHFSGRAEDADSS<br>SGPLASSSLLAKMRARNHLILPERLESESGHLQEASALLPTTEHDDLLVEMRNFIAFQAH<br>TDGQASTREILQEFESKLSASQSCVFRELLRNLCTFHRTSGGEGIWKLKPEYC |
| XPA | >sp|P23025|XPA_HUMAN DNA repair protein complementing XP-A cells OS = Homo sapiens GN = XPA PE = 1 SV = 1<br>MAAADGALPEAAALEQPAELPASVRASIERKRQRALMLRQARLAARPYSATAAAATGGMA<br>NVKAAPKIIDTGGGFILEEEEEEQKIGKVVHQPGPVMEFDYVICEECGKEFMDSYLMNH<br>FDLPTCDNCRDADDKHKLITKTEAKQEYLLKDCDLEKREPPLKFIVKKNPHHSQWGDMKL<br>YLKLQIVKRSLEVWGSQEALEEAKEVRQENREKMKQKKFDKKVKELRRAVRSSVWKRETI<br>VHQHEYGPEENLEDDMYRKTCTMCGHELTYEKM |
| XPB | MGKRDRADRDKKKSRKRHYEDEEDDEEDAPGNDPQEAVPSAAGKQVDESGTKVDEYGAKD<br>YRLQMPLKDDHTSRPLWVAPDGHIFLEAPSPVYKYAQDFLVAIAEPVCRPTHVHEYKLTA<br>YSLYAAVSVGLQTSDITEYLRKLSKTGVPDGIMQFIKLCTVSYGKVKLVLKHNRYFVESC<br>HPDVIQHLLQDPVIRECRLRNSEGEATELITETFTSKSAISKTAESSGGPSTSRVTDPQG<br>KSDIPMDLFDFYEQMDKDEEEEETQTVSFEVKQEMIEELQKRCIHLEYPLLAEYDFRND<br>SVNPDINIDLKPTAVLRPYQEKSLRKMFGNGRARSGVIVLPCGAGKSLVGVTAACTVRKR<br>CLVLGNSAVSVEQWKAQFKMWSTIDDSQICRFTSDAKDKPIGCSVAISTYSMLGHTTKRS<br>WEAERVMEWLKTQEWGLMILDEVHTIPAKMFRRVLTIVQAHCKLGLTATLVREDDKIVDL<br>NFLIGPKLYEANWMELQNNGYIAKVQCAEVWCPMSPEFYREYVAIKTKKRILLYTMNPNK<br>FRACQFLIKFHERRNDKIIVFADNVFALKEYAIRLNKPYIYGPTSQGERMQILQNFKHNP<br>KINTIFISKVGDTSFDLPEANVLIQISSHGGSRRQEAQRLGRVLRAKKGMVAEEYNAFFY<br>SLVSQDTQEMAYSTKRQRFLVDQGYSFKVITKLAGMEEEDLAFSTKEEQQQLLQKVLAAT<br>DLDAEEEVVAGEFGSRSSQASRRFGTMSSMSGADDTVYMEYHSSRSKAPSKHVHPLFKRF<br>RK (XPB CCDS 2144.1) |
| XPC | >sp|Q01831|XPC_HUMAN DNA repair protein complementing XP-C cells OS = Homo sapiens GN = XPC PE = 1 SV = 4<br>MARKRAAGGEPRGRELRSQKSKAKSKARREEEEEDAFEDEKPPKKSLLSKVSQGKRKRGC<br>SHPGGSADGPAKKKVAKVTVKSENLKVIKDEALSDGDDLRDFPSDLKKAHHLKRGATMNE<br>DSNEEEEESENDWEEVEELSEPVLGDVRESTAFSRSLLPVKPVEIEIETPEQAKTRERSE<br>KIKLEFETYLRRAMKRFNKGVHEDTHKVHLLCLLANGFYRNNICSQPDLHAIGLSIIPAR<br>FTRVLPRDVDTYYLSNLVKWFIGTFTVNAELSASEQDNLQTTLERRFAIYSARDDEELVH<br>IFLLILRALQLLTRLVLSLQPIPLKSATAKGKKPSKERLTADPGGSSETSSQVLENHTKP<br>KTSKGTKQEETFAKGTCRPSAKGKRNKGGRRKKSRKPSSSEEDEGPGDKQEKATQRRPHGR |

TABLE VI.18-continued

Factors Involved in NER.

| Factor | Sequence |
|---|---|
| | ERRVASRVSYKEESGSDEAGSGSDFELSSGEASDPSDEDSEPGPPKQRKAPAPQRTKAGS<br>KSASRTHRGSHRKDPSLPAASSSSSSSKRGKKMCSDGEKAEKRSIAGIDQWLEVFCEQEE<br>KWVCVDCVHGVVGQPLTCYKYATKPMTYVVGIDSDGWVRDVTQRYDPVWMTVTRKCRVDA<br>EWWAETLRPYQSPPFMDREKKEDLEFQAKHMDQPLPTAIGLYKNHPLYALKRHLLKYEATY<br>PETAAILGYCRGEAVYSRDCVHTLHSRDTWLKKARVVRLGEVPYKMVKGFSNRARKARLA<br>EPQLREENDLGLFGYWQTEEYQPPVAVDGKVPRNEFGNVYLFLPSMMPIGCVQLNLPNLH<br>RVARKLDIDCVQAITGFDFHGGYSHPVTDGYIVCEEFKDVLLTAWENEQAVIERKEKEKK<br>EKRALGNWKLLAKGLLIRERLKRRYGPKSEAAAPHTDAGGGLSSDEEEGTSSQAEAARIL<br>AASWPQNREDEEKQKLKGGPKKTKREKKAAASHLFPFEQL<br>>sp|Q01831-2|XPC_HUMAN Isoform 2 of DNA repair protein complementing<br>XP-C cells OS = Homo sapiens GN = XPC<br>MARKRAAGGEPRGRELRSQKSKAKSKARREEEEEDAFEDEKPPKKSLLSKVSQGKRKRGC<br>SHPGGSADGPAKKKVAKVTVKSENLKVIKDEALSDGDDLRDFPSDLKKAHHLKRGATMNE<br>DSNEEEEESENDWEEAKTRERSEKIKLEFETYLRRAMKRFNKGVHEDTHKVHLLCLLANG<br>FYRNNICSQPDLHAIGLSIIPARFTRVLPRDVDTYYLSNLVKWFIGTFTVNAELSASEQD<br>NLQTTLERRFAIYSARDDEELVHIFLLILRALQLLTRLVLSLQPIPLKSATAKGKKPSKE<br>RLTADPGGSSETSSQVLENHTKPKTSKGTKQEETFAKGTCRPSAKGKRNKGGRKKRSKPS<br>SSEEDEGPGDKQEKATQRRPHGRERRVASRVSYKEESGSDEAGSGSDFELSSGEASDPSD<br>EDSEPGPPKQRKAPAPQRTKAGSKSASRTHRGSHRKDPSLPAASSSSSSSKRGKKMCSDG<br>EKAEKRSIAGIDQWLEVFCEQEEKWVCVDCVHGVVGQPLTCYKYATKPMTYVVGIDSDGW<br>VRDVTQRYDPVWMTVIRKCRVDAEWWAETLRPYQSPFMDREKKEDLEFQAKHMDQPLPTA<br>IGLYKNHPLYALKRHLLKYEATYPETAAILGYCRGEAVYSRDCVHTLHSRDTWLKKARVV<br>RLGEVPYKMVKGFSNRARKARLAEPQLREENDLGLFGYWQTEEYQPPVAVDGKVPRNEFG<br>NVYLFLPSMMPIGCVQLNLPNLHRVARKLDIDCVQAITGFDFHGGYSHPVTDGYIVCEEF<br>KDVLLTAWENEQAVIERKEKEKKEKRALGNWKLLAKGLLIRERLKRRYGPKSEAAAPHTD<br>AGGGLSSDEEEGTSSQAEAARILAASWPQNREDEEKQKLKGGPKKTKREKKAAASHLFPF<br>EQL<br>>sp|Q01831-3|XPC_HUMAN Isoform 3 of DNA repair protein complementing<br>XP-C cells OS = Homo sapiens GN = XPC<br>MARKRAAGGEPRGRELRSQKSKAKSKARREEEEEDAFEDEKPPKKSLLSKVSQGKRKRGC<br>SHPGGSADGPAKKKVAKVTVKSENLKVIKDEALSDGDDLRDFPSDLKKAHHLKRGATMNE<br>DSNEEEEESENDWEEVEVKR |
| XPD | MKLNVDGLLVYFPYDYTYPEQFSYMRELKRTLDAKGHGVLEMPSGTGKTVSLLALIMAYQ<br>RAYPLEVTKLIYCSRTVPEIEKVIEELRKLLNFYEKQEGEKLPFLGLALSSRKNLCIHPE<br>VTPLRFGKDVDGKCHSLTASYVRAQYQHDTSLPHCRFYEEFDAHGREVPLPAGIYNLDDL<br>KALGRRQGWCPYFLARYSILHANVVVYSYHYLLDPKIADLVSKELARKAVVVFDEAHNID<br>NVCIDSMSVNLTRRTLDRCQGNLETLQKTVLRIKETDEQRLRDEYRRLVEGLREASAARE<br>TDAHLANPVLPDEVLQEAVPGSIRTAEHFLGFLRRLLEYVKWRLRVQHVVQESPPAFLSG<br>LAQRVCIQRKPLRFCAERLRSLLHTLEITDLADFSPLTLLANFATLVSTYAKGFTIIIEP<br>FDDDRTPTIANPILHFSCMDASLAIKPVFERFQSVIITSGTLSPLDIYPKILDFHPVTMAT<br>FTMTLARVCLCPMIIGRGNDQVAISSKFETREDIAVIRNYGNLLLEMSAVVPDGIVAFFT<br>SYQYMESTVASWYEQGILENIQRNKLLFIETQDGAETSVALEKYQEACENGRGAILLSVA<br>RGKVSEGIDFVHHYGRAVIMFGVPYVYTQSRILKARLEYLRDQFQIRENDFLTFDAMRHA<br>AQCVGRAIRGKTDYGLMVFADKRFARGDKRGKLPRWIQEHLTDANLNLTVDEGVQVAKYF<br>LRQMAQPPHREDQLGLSLLSLEQLESEETLKRIEQIAQQL (XPD Isoform 1<br>CCDS 33049.1)<br>MRELKRTLDAKGHGVLEMPSGTGKTVSLLALIMAYQRAYPLEVTKLIYCSRTVPEIEKVI<br>EELRKLLNFYEKQEGEKLPFLGLALSSRKNLCIHPEVTPLRFGKDVDGKCHSLTASYVRA<br>QYQHDTSLPHCRFYEEFDAHGREVPLPAGIYNLDDLKALGRRQGWCPYFLARYSILHANV<br>VVYSYHYLLDPKIADLVSKELARKAVVVFDEAHNIDNVCIDSMSVNLTRRTLDRCQGNLE<br>TLQKTVLRIKETDEQRLRDEYRRLVEGLREASAARETDAHLANPVLPDEVLQEAVPGSIR<br>TAEHFLGFLRRLLEYVKWRLRVQHVVQESPPAFLSGLAQRVCIQRKPLRFCAERLRSLLH<br>TLEITDLADFSPLTLLANFATLVSTYAKGQAQHCGSSRNQKRSHP (XPD<br>Isoform 2 CCDS 46112.1) |
| XPF | See Table VI.9 |
| XPG | MGVQGLWKLLECSGRQVSPEALEGKILAVDISIWLNQALKGVRDRHGNSIENPHLLTLFH<br>RLCKLLFFRIRPIFVFDGDAPLLKKQTLVKRRQRKDLASSDSRKTTEKLLKTFLKRQAIK<br>TAFRSKRDEALPSLTQVRRENDLYVLPPLQEEEKHSSEEEDEKEWQERMNQKQALQEEFF<br>HNPQAIDIESEDFSSLPPEVKHEILTDMKEFTKRRRTLFEAMPEESDDFSQYQLKGLLKK<br>NYLNQHIEHVQKEMNQQHSGHIRRQYEDEGGFLKEVESRRVVSEDTSHYILIKGIQAKTV<br>AEVDSESLPSSSKMHGMSFDVKSSPCEKLKTEKEPDATPPSPRILLAMQAALLGSSSEEE<br>LESENRRQARGRNAPAAVDEGSISPRTLSAIKRALDDDEDVKVCAGDDVQTGGPGAEEMR<br>INSSTENSDEGLKVRDGKGIPFTATLASSSVNSAEEHVASTNEGREPTDSVPKEQMSLVH<br>VGTEAFPISDESMIKDRKDRLPLESAVVRHSDAPGLPNGRELTPASPTCTNSVSKNETHA<br>EVLEQQNELCPYESKFDSSLLSSDDETKCKPNSASEVIGPVSLQETSSIVSVPSEAVDNV<br>ENVVSFNAKEHENFLETIQEQQTTESAGQDLISIPKAVEPMEIDSEESESDGSFIEVQSV<br>ISDEELQAEFPETSKPPSEQGEEELVGTREGEAPAESESLLRDNSERDDVDGEPQEAEKD<br>AEDSLHEWQDINLEEETLESNLLAQQQNSLKAQKQQQERIAATVTGQMFLESQELLRLFG<br>IPYIQAPMEAEAQCAILDLTDQTSGTITDDSDIWLFGARHVYRNFFNKNKFVEYYQYVDF<br>HNQLGLDRNKLINLAYLLGSDYTEGIPTVGCVTAMEILNEFPGHGLEPLLKFSEWWHEAQ<br>KNPKIRPNPHDTKVKKKLRILQLTPGFPNPAVAEAYLKPVDDSKGSFLWGKPDLDKIRE<br>FCQRYFGWNRTKTDESLPVLKQLDAQQQTQLRIDSFFRLAQQEKEDAKRIKSQRLNRAVT<br>CMLRKEKEAAASEIEAVSVAMEKEFELLDKAKGKTQKRGITNTLEESSSLKRKRLSDSKG |

TABLE VI.18-continued

Factors Involved in NER.

| Factor | Sequence |
|---|---|
| | KNTCGGFLGETCLSESSDGSSSEDAESSSLMNVQRRTAAKEPKTSASDSQNSVKEAPVKN GGATTSSSSDSDDDGGKEKMVLVTARSVFGKKRRKLRRARGRKRKT (XPG CCDS 32004.1) |
| ERCC1 | See Table VI.9 |
| TTDA | >sp\|Q6ZYL4\|TF2H5_HUMAN General transcription factor IIH subunit 5 OS = Homo sapiens GN = GTF2H5 PE = 1 SV = 1<br>MVNVLKGVLIECDPAMKQFLLYLDESNALGKKFIIQDIDDTHVFVIAELVNVLQERVGEL MDQNAFSLTQK |
| UVSSA | >sp\|Q2YD98\|UVSSA_HUMAN UV-stimulated scaffold protein A OS = Homo sapiens GN = UVSSA PE = 1 SV = 2<br>MDQKLSKLVEELTTSGEPRLNPEKMKELKKICKSSEEQLSRAYRLLIAQLTQEHAEIRLS AFQIVEELFVRSHQFRMLVVSNFQEFLELTLGTDPAQPLPPPREAAQRLRQATTRAVEGW NEKFGEAYKKLALGYHFLRHNKKVDFQDTNARSLAERKREEEKQKHLDKIYQERASQAER EMQEMSGEIESCLTEVESCFRLLVPFDFDPNPETESLGMASGMSDALRSSCAGQVGPCRS GTPDPRDGEQPCCSRDLPASAGHPRAGGGAQPSQTATGDPSDEDEDSDLEEFVRSHGLGS HKYTLDVELCSEGLKVQENEDNLALIHAARDTLKLIRNKFLPAVCSWIQRFTRVGTHGGC LKRAIDLKAELELVLRKYKELDIEPEGGERRRTEALGDAEEDEDDEDFVEVPEKEGYEPH IPDHLRPEYGLEAAPEKDTVVRCLRTRTRMDEEVSDPTSAAAQLRQLRDHLPPPSSASPS RALPEPQEAQKLAAERARAPVVPYGVDLHYWGQELPTAGKIVKSDSQHRFWKPSEVEEEV VNADISEMLRSRHITFAGKFEPVQHWCRAPRPDGRLCERQDRLKCPFHGKIVPRDDEGRP LDPEDRAREQRRQLQKQERPEWQDPELMRDVEAATGQDLGSSRYSGKGRGKKRRYPSLTN LKAQADTARARIGRKVFAKAAVRRVVAAMNRMDQKKHEKFSNQFNYALN<br>>sp\|Q2YD98-2\|UVSSA_HUMAN Isoform 2 of UV-stimulated scaffold protein A OS = Homo sapiens GN = UVSSA<br>MDEEVSDPISAAAQLRQLRDHLPPPSSASPSRALPEPQEAQKLAAERARAPVVPYGVDLH YWGQELPTAGKIVKSDSQHRFWKPSEVEEEVVNADISEMLRSRHITFAGKFEPVQHWCRA PRPDGRLCERQDRLKCPFHGKIVPRDDEGRPLDPEDRAREQRRQLQKQERPEWQDPELMR DVEAATGQDLGSSRYSGKGRGKKRRYPSLTNLKAQADTARARIGRKVFAKAAVRRVVAAM NRMDQKKHEKFSNQFNYALN |
| USP7 | >sp\|Q93009\|UBP7_HUMAN Ubiquitin carboxyl-terminal hydrolase 7 OS = Homo sapiens GN = USP7 PE = 1 SV = 2<br>MNHQQQQQQKAGEQQLSEPEDMEMEAGDTDDPPRITQNPVINGNVALSDGHNTAEEDME DDTSWRSEATFQFTVERFSRLSESVLSPPCFVRNLPWKIMVMPRFYPDRPHQKSVGFFLQ CNAESDSTSWSCHAQAVLKIINYRDDEKSFSRRISHLFFHKENDWCFSNFMAWSEVIDPE KGFIDDDKVTFEVFVQADAPHGVAWDSKKHTGYVGLKNQGATCYMNSLLQTLFFTNQLRK AVYMMPTEGDDSSKSVPLALQRVFYELQHSDKPVGIKKLIKSFGWEILDSFMQHDVQELC RVLLDNVENKMKGTCVEGTIPKLFRGKMVSYIQCKEVDYRSDRREDYYDIQLSIKGKKNI FESFVDYVAVEQLDGDNKYDAGEHGLQEAEKGVKFLTLPPVLHLQLMRFMYDPQTDQNIK INDRFEFPEQLPLDEFLQKTDPKDPANYILHAVLVHSGDNHGGHYVVYLNPKGDGKWCKF DDDVVSRCTKEEAIEHNYGGHDDDLSVRHCTNAYMLVYIRESKLSEVLQAVTDHDIPQQL VERLQEEKRIEAQKRKERQEAHLYMQVQIVAEDQFCGHQGNDMYDEEKVKYTVFKVLKNS SLAEFVQSLSQTMGFPQDQIRLWPMQARSNGTKRPAMLDNEADGNKTMIELSDNENPWTI FLETVDPELAASGATLPKFDKDHDVMLFLKMYDPKTRSLNYCGHIYTPISCKIRDLLPVM CDRAGFIQDTSLILYEEVKPNLTERIQDYDVSLDKALDELMDGDIIVFQKDDPENDNSEL PTAKEYFRDLYHRVDVIFCDKTIPNDPGFVVTLSNRMNYFQVAKTVAQRLNTDPMLLQFF KSQGYRDGPGNPLRHNYEGTLRDLLQFFKPRQPKKLYYQQLKMKITDFENRRSFKCIWLN SQFREEEITLYPDKHGCVRDLLEECKKAVELGEKASGKLRLLEIVSYKIIGVHQEDELLE CLSPATSRTFRIEEIPLDQVDIDKENEMLVTVAHFHKEVFGTFGIPFLLRIHQGEHFREV MKRIQSLLDIQEKEFEKFKFAIVMMGRHQYINEDEYEVNLKDFEPQPGNMSHPRPWLGLD HFNKAPKRSRYTYLEKAIKIHN<br>>sp\|Q93009-3\|UBP7_HUMAN Isoform 3 of Ubiquitin carboxyl-terminal hydrolase 7 OS = Homo sapiens GN = USP7<br>MAGNHRLGLEAGDTDDPPRITQNPVINGNVALSDGHNTAEEDMEDDTSWRSEATFQFTVE RFSRLSESVLSPPCFVRNLPWKIMVMPRFYPDRPHQKSVGFFLQCNAESDSTSWSCHAQA VLKIINYRDDEKSFSRRISHLFFHKENDWGFSNFMAWSEVIDPEKGFIDDDKVIFEVFVQ ADAPHGVAWDSKKHIGYVGLKNQGATCYMNSLLQTLFFINQLRKAVYMMPTEGDDSSKSV PLALQRVFYELQHSDKPVGTKKLTKSFGWETLDSFMQHDVQELCRVLLDNVENKMKGTCV EGTIPKLFRGKMVSYIQCKEVDYRSDRREDYYDIQLSIKGKKNIFESFVDYVAVEQLDGD NKYDAGEHGLQEAEKGVKFLTLPPVLHLQLMRFMYDPTDQNIKINDRFEFPEQLPLDEF LQKTDPKDPANYILHAVLVHSGDNHGGHYVVYLNPKGDGKWCKFDDDVVSRCTKEEAIEH NYGGHDDDLSVRHCTNAYMLVYIRESKLSEVLQAVTDHDIPQQLVERLQEEKRIEAQKRK ERQEAHLYMQVQIVAEDQFCGHQGNDMYDEEKVKYTVFKVLKNSSLAEFVQSLSQTMGFP QDQIRLWPMQARSNGTKRPAMLDNEADGNKTMIELSDNENPWTIFLETVDPELAASGAIL PKFDKDHDVMLFLKMYDPKTRSLNYCGHIYTPISCKIRDLLPVMCDRAGFIQDTSLILYE EVKPNLTERIQDYDVSLDKALDELMDGDIIVFQKDDPENDNSELPTAKEYFRDLYHRVDV IFCDKTIPNDPGFVVILSNRMNYFQVAKTVAQRLNIDPMLLQFFKSQGYRDGPGNPLRHN YEGTLRDLLQFFKPRQPKKLYYQQLKMKITDFENRRSFKCIWLNSQFREEEITLYPDKHG CVRDLLEECKKAVELGEKASGKLRLLEIVSYKIIGVHQEDELLECLSPATSRTFRIEEIP LDQVDIDKENEMLVTVAHFHKEVFGTFGIPFLLRIHQGEHFREVMKRIQSLLDIQEKEFE KFKFAIVMMGRHQYINEDEYEVNLKDFEPQPGNMSHPRPWLGLDHFNKAPKRSRYTYLEK AIKIHN |

TABLE VI.18-continued

Factors Involved in NER.

| Factor | Sequence |
|---|---|
| CETN2 | >sp\|P41208\|CETN2_HUMAN Centrin-2 OS = *Homo sapiens* GN = CETN2 PE = 1 SV = 1<br>MASNFKKANMASSSQRKRMSPKPELTEEQKQEIREAFDLFDADGTGTIDVKELKVAMRAL<br>GFEPKKEEIKKMISEIDKEGTGKMNFGDFLTVMTQKMSEKDTKEEILKAFKLFDDDETGK<br>ISFKNLKRVAKELGENLTDEELQEMIDEADRDGDGEVSEQEFLRIMKKTSLY |
| RAD23B | >sp\|P54727\|RD23B_HUMAN UV excision repair protein RAD23 homolog B<br>OS = *Homo sapiens* GN = RAD23B PE = 1 SV = 1<br>MQVTLKTLQQQTFKIDIDPEETVKALKEKIESEKGKDAFPVAGQKLIYAGKILNDDTALK<br>EYKIDEKNFVVVMVIKPKAVSTPAPATTQQSAPASTTAVISSITTIVAQAPTPVPALAPT<br>STPASITPASATASSEPAPASAAKQEKPAEKPAETPVATSPTATDSTSGDSSRSNLFEDA<br>TSALVTGQSYENMVTEIMSMGYEREQVIAALRASFNNPDRAVEYLLMGIPGDRESQAVVD<br>PPQAASTGAPQSSAVAAAAATTTATTTTTSSGGHPLEFLRNQPQFQQMRQIIQQNPSLLP<br>ALLQQIGRENPQLLQQISQHQEHFIQMLNEPVQEAGGQGGGGGGSGGIAEAGSGHMNYI<br>QVTPQEKEAIERLKALGFPEGLVIQAYFACEKNENLAANFLLQQNFDED<br><br>>sp\|P54727-2\|RD23B_HUMAN Isoform 2 of UV excision repair protein<br>RAD23 homolog B OS = *Homo sapiens* GN = RAD23B<br>MVTKPKAVSTPAPATTQQSAPASTTAVTSSTTTTVAQAPTPVPALAPTSTPASITPASAT<br>ASSEPAPASAAKQEKPAEKPAETPVATSPTATDSTSGDSSRSNLFEDATSALVTGQSYEN<br>MVTEIMSMGYEREQVIAALRASFNNPDRAVEYLLMGIPGDRESQAVVDPPQAASTGAPQS<br>SAVAAAAATTTATTTTTSSGGHPLEFLRNQPQFQQMRQIIQQNPSLLPALLQQIGRENPQ<br>LLQQISQHQEHFIQMLNEPVQEAGGQGGGGGGSGGIAEAGSGHMNYIQVTPQEKEATER<br>LKALGFPEGLVIQAYFACEKNENLAANFLLQQNFDED |
| UV-DDB | >sp\|Q92466\|DDB2_HUMAN DNA damage-binding protein 2 OS = *Homo sapiens*<br>GN = DDB2 PE = 1 SV = 1<br>MAPKKRPETQKTSEIVLRPRNKRSRSPLELEPEAKKLCAKGSGPSRRCDSDCLWVGLAGP<br>QILPPCRSIVRTLHQHKLGRASWPSVQQGLQQSFLHTLDSYRILQKAAPFDRRATSLAWH<br>PTHPSTVAVGSKGGDIMLWNFGIKDKPTFIKGIGAGGSITGLKFNPLNTNQFYASSMEGT<br>TRLQDFKGNILRVFASSDTINIWFCSLDVSASSRMVVTGDNVGNVILLNMDGKELWNLRM<br>HKKKVTHVALNPCCDWFLATASVDQTVKIWDLRQVRGKASFLYSLPHRHPVNAACFSPDG<br>ARLLTTDQKSEIRVYSASQWDCPLGLIPHPHRHFQHLTPIKAAWHPRYNLIVVGRYPDPN<br>FKSCTPYELRTIDVFDGNSGKMMCQLYDPESSGISSLNEFNPMGDTLASAMGYHILIWSQ<br>EEARTRK<br>>sp\|Q92466-2\|DDB2_HUMAN Isoform D1 of DNA damage-binding protein 2<br>OS = *Homo sapiens* GN = DDB2<br>MAPKKRPETQKTSEIVLRPRNKRSRSPLELEPEAKKLCAKGSGPSRRCDSDCLWVGLAGP<br>QILPPCRSIVRTLHQHKLGRASWPSVQQGLQQSFLHTLDSYRILQKAAPFDRRATSLAWH<br>PTHPSTVAVGSKGGDIMLWNFGIKDKPTFIKGAAWHPRYNLIVVGRYPDPNFKSCTPYEL<br>RTIDVFDGNSGKMMCQLYDPESSGISSLNEFNPMGDTLASAMGYHILIWSQEEARTRK<br>>sp\|Q92466-3\|DDB2_HUMAN Isoform D2 of DNA damage-binding protein 2<br>OS = *Homo sapiens* GN = DDB2<br>MAPKKRPETQKTSEIVLRPRNKRSRSPLELEPEAKKLCAKGSGPSRRCDSDCLWVGLAGP<br>QILPPCRSIVRTLHQHKLGRASWPSVQQGLQQSFLHTLDSYRILQKAAPFDRRATSLAWH<br>PTHPSTVAVGSKGGDIMLWNFGIKDKPTFIKGHLVL<br>>sp\|Q92466-4\|DDB2_HUMAN Isoform D3 of DNA damage-binding protein 2<br>OS = *Homo sapiens* GN = DDB2<br>MAPKKRPETQKTSEIVLRPRNKRSRSPLELEPEAKKLCAKGSGPSRRCDSDCLWVGLAGP<br>QILPPCRSIVRTLHQHKLGRASWPSVQQIGAGGSITGLKFNPLNTNQFYASSMEGTTRLQ<br>DFKGNILRVFASSDTINIWFCSLDVSASSRMVVTGDNVGNVILLNMDGKELWNLRMHKKK<br>VTHVALNPCCDWFLATASVDQTVKIWDLRQVRGKASFLYSLPHRHPVNAACFSPDGARLL<br>TTDQKSEIRVYSASQWDCPLGLIPHPHRHFQHLTPIKAAWHPRYNLIVVGRYPDPNFKSC<br>TPYELRTIDVFDGNSGKMMCQLYDPESSGISSLNEFNPMGDTLASAMGYHILIWSQEEAR<br>TRK<br>>sp\|Q92466-5\|DDB2_HUMAN Isoform D4 of DNA damage-binding protein 2<br>OS = *Homo sapiens* GN = DDB2<br>MAPKKRPETQKTSEIVLRPRNKRSRSPLELEPEAKKLCAKGSGPSRRCDSDCLWVGLAGP<br>QILPPCRSIVRTLHQHKLGRASWPSVQQGLQQSFLHTLDSYRILQKAAPFDRRATSLAWH<br>PTHPSTVAVGSKGGDIMLWNFGIKDKPTFIKGIGAGGSITGLKFNPLNTNQFYASSMEGT<br>TRLQDFKGNILRVFASSDTINIWFCSLDVSASSRMVVTGDNVGNVILLNMDGKELVSVPM<br>EPGS |
| CAK subcomplex | — |
| RPA | — |
| PCNA | VI.13 |

More specifically, in some embodiments, the down-regulator of the NER pathway may be an inhibitor of (e.g., an siRNA against) one or more factors of Table VI.18, or any combination thereof. Inhibitors of some of the proteins of Table VI.18 above are listed elsewhere in this specification.

VI.10 Other Pathways

Several other DNA repair pathways exist in mammals. A dedicated pathway called the ICL repair pathway repairs interstrand crosslinks. ICL repair can involve the following factors: XPF and RAD51C. Translesion synthesis (TLS) is a pathway for repairing a single strand break left after a defective replication event. Error-free postreplication repair (PRR) is another pathway for repairing a single strand break left after a defective replication event.

In some embodiments, the methods herein do not substantially inhibit one or more of, e.g., all of, ICL repair, TLS, and PRR.

VI.11 The Role of Epigentic Modification in DNA Repair

Breaks, e.g., DSBs, are characterized by distinct chromatin structure. This chromatin structure affects DNA repair.

In some embodiments, HDR repair is promoted by modulating the chromatin structure at the site of the DNA lesion. For example, in some embodiments, a Cas9 molecule and gRNA can induce a DSB in a desired location during G2 or another phase of the cycle. This DSB can be formed using, e.g., one Cas9 molecule with the ability to produce DSBs, or two nickases. In S/G2, a chromatin structure modulator can increase the likelihood that a DSB is repaired by HDR. A template nucleic acid can be added to the cell, so that the HDR machinery repairs the DSB using the template nucleic acid.

Upon formation of a double strand break, ATM and MDC1 (which can activate canonical NHEJ and HDR) allow recruitment of gamma-H2AX, a specialized histone, to a 1-2 megabase region surrounding the break. When no damage is detected, gamma-H2AX is kept in an inactive, phosphorylated state by the kinase WSTF. Upon damage sensing, EYA1 and EYA2 dephosphorylate and activate gamma-H2AX. Once gamma-H2AX is recruited to the break, it promotes repair via a number of DNA repair factors.

For instance, gamma-H2AX helps to prolong the association of NBS1, BRCA1, and 53BP1 at DSB regions (after their initial recruitment by PARP1). This effect may be mediated through a host of chromatin modifying enzymes including INO80 (to remove nucleosomes) and SWI/SNF (to relax the chromatin). MCPH1 may assist gamma-H2AX in stabilizing SWI/SNF association near the damage site.

Another chromatin modification at DNA damage sites is ubiquitination of K63 of H2A and gamma-H2AX. Ubiquitination (mono- or poly-ubiquitination) of K63 is performed by the ubiquitin ligase RNF8, which in turn recruits the BRCA1-A complex. This complex also has ubiquitin ligase activity (due to the BRE subunit, the BRCC36 subunit, and NAB1).

Sumoylation is another important modification of proteins near the break site, because it promotes association of BRCA1-A complex. PIAS1, a SUMO ligase, catalyzes sumoylation of BRCA1 to stimulate its ubiquitin ligase activity. PIAS4, another SUMO ligase, catalyzes sumoylation of 53BP1.

Sometimes a combination of histone modifications is required to recruit a factor. For example, 53BP1 contains Tudor domains that bind to mono- and dimethylated H4K20 and acetylated H4K16, as well as a motif that binds to ubiquitinylated H2AK15. Although methylated H2K20 is abundant in the genome, in the absence of DNA damage it is masked by JMJD2A (also referred to as KDM4A). The masking proteins are removed from damaged regions, allowing the recruitment of 53BP1. As to the H4K16 acetylation, this seems to be provided by HDAC1 and HDAC2, making these proteins promoters of the canonical NHEJ pathway.

Sites of DNA damage or lesions become enriched in histone methyltransferases complexes (e.g., polycomb proteins, histone deacetylases such as HDACs and sirtuins, and DNA methyltransferases).

DNA repair in heterochromatin requires loosening the tightly packed chromatin. When DNA is damaged, CHK2 phosphorylates HP1, causing HP1 to disassociate it from its usual position on the methylated K9 of histone H3. Further relaxation of the chromatin occurs when TIP60 (KATS) acetylates H3, H4, and gamma-H2AX. Tip60 is recruited to double strand breaks and inhibits 53BP1 association. KAP1 also localizes to damaged heterochromatin, where it promotes chromatin relaxation. Another repair factor that localizes to damaged heterochromatin is EXPAND1, a chromatin remodeling factor that deconsenses chromatin. EXPAND1 is recruited to DSBs in a 53BP1-dependent manner.

Accordingly, in some embodiments, the methods herein involve modifying chromatin in order to promote HDR (e.g., HR, SSA or alt-HR). For instance, the methods may involve modulating, e.g., inhibiting, a chromatin-modifying factor (e.g., exactly one factor, or one or more factors). More specifically, the methods may involve modulating, e.g., inhibiting, exactly one of, or one or more of gamma-H2AX, WSTF, EYA1, EYA2, INO80, SWI/SNF, MCPH1, a ubiquitin ligase, RNF8, BRCA1, BRCA1-A, a SUMO ligase, PIAS1, JMJD2A, a histone deacetylase, HDAC1, HDAC2, CHK2, TIP60, KAP1, EXPAND1, or a component of Table VI.1(I), or any combination thereof. In some embodiments, the methods involve promoting HDR by inhibiting exactly one of, or one or more of MDC1, HDAC1, HDAC2. Up-regulation of HDR, in some embodiments, is achieved using siRNA directed against one or more of gamma-H2AX, WSTF, EYA1, EYA2, INO80, SWI/SNF, MCPH1, a ubiquitin ligase, RNF8, BRCA1, BRCA1-A, a SUMO ligase, PIAS1, JMJD2A, a histone deacetylase, HDAC1, HDAC2, CHK2, TIP60, KAP1, EXPAND1, or a component of Table VI.1(I), or any combination thereof. In some embodiments, a chromatin-modifying factor is down regulated using an HDR-enhancing gRNA that targets a chromatin-modifying factor, e.g., one or more of the components listed in Table VI.18 (e.g., one or more of gamma-H2AX, WSTF, EYA1, EYA2, INO80, SWI/SNF, MCPH1, a ubiquitin ligase, RNF8, BRCA1, BRCA1-A, a SUMO ligase, PIAS1, JMJD2A, a histone deacetylase, HDAC1, HDAC2, CHK2, TIP60, KAP1, EXPAND1, or a component of Table VI.1(I), or any combination thereof). In some embodiments, the HDR-enhancing gRNA is used in combination with an eiCas9 molecule. In some embodiments, the HDR-enhancing gRNA is used in combination with an eaCas9 molecule. In some embodiments, the HDR-enhancing gRNA is administered to the cell as a HDR-enhancing gRNA:Cas9 molecule complex.

In some embodiments, modifying the chromatin results in substantial inhibition of only DNA damage repair pathway e.g., exactly one of HDR, alt-HR, anti-HR, NHEJ, alt-NHEJ, MMEJ, SSBR, or SSA.

More specifically, in some embodiments, the chromatin structure modifier is an EZH2 inhibitor e.g., EPZ-6438 or an HDAC inhibitor e.g., TCA, or any combination thereof. In some embodiments, the EZH2 inhibitor modifies, e.g., inhibits, histone H3 trimethylation of residue K27. In some embodiments, the HDAC inhibitor modifies, e.g., promotes, histone H4 acetylation at residue K16. In some embodiments, an HDAC inhibitor does not interfere with HDR, e.g., the HDAC inhibitor does not interfere with recruitment of factors that promote HDR.

TABLE VI.19
HDR-enhancers that are chromatin structure modifiers
1. EZH2
| Compounds | Phase | Structure |
|---|---|---|
| GSK343 | | 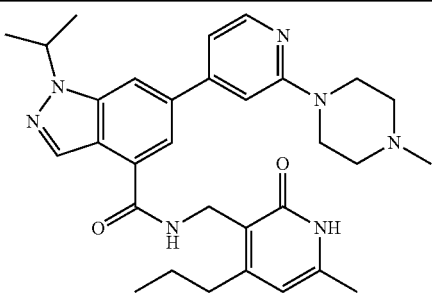 |
| EPZ-6438 | Phase I/II | 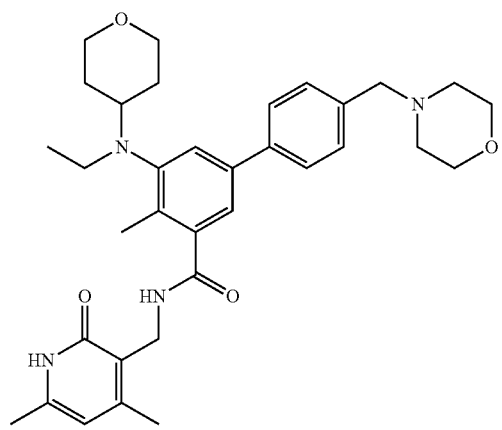 [SMILES: CCN(c1cc(-c2ccc(CN3CCOCC3)cc2)cc(C(=O)NCc2c(C)cc(C)[nH]c2=O)c1C)C1CCOCC1] |
| GSK2816126 | Phase I | |
| SureCN6120847 | | 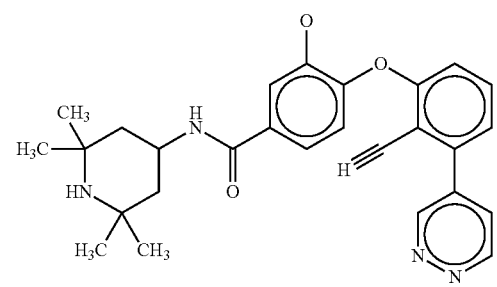 |
| EPZ005687 | | 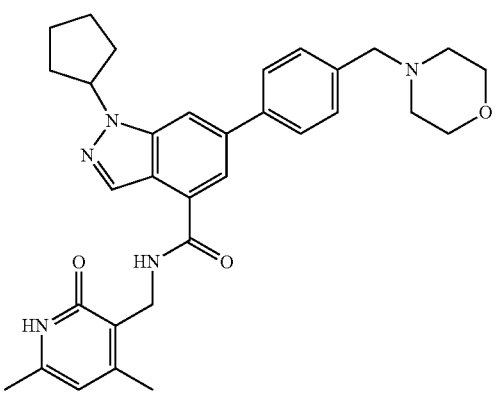 |
| siRNAs | | Accell Human EZH2 siRNA, sold by Dharmacon; EZH2 Silencer, sold by Life Technologies |
| antibodies | | EZH2 monoclonal antibody (M07), clone 1D11, sold by Abnova Ezh2 Antibody, sold by Cell Signaling Technology |

TABLE VI.19-continued

HDR-enhancers that are chromatin structure modifiers

2. HDAC-HDACI & II inhibitors

Compounds
Trichostatin A (TSA)
Sodium Butyrate (NaB)
siRNA

| | |
|---|---|
| HDAC1 | CAGCGACUGUUUGAGAACC (sense) |
| | CUAAUGAGCUUCCAUACAA (sense) |
| HDAC2 | Accell Human HDAC2 siRNA, sold by Dharmacon; |
| | HDAC2 Silencer, sold by Life Technologies; |
| | GCGGAUAGCUUGUGAUGAA (sense); |
| | GCAAAGAAAGCUAGAAUUG (sense) |
| antibodies | |
| HDAC2 | HDAC2 Antibody, sold by Cell Signalling Technology |
| | HDAC2 Antibody, sold by Novus Biologicals |

3. Histone Demethylation

| | |
|---|---|
| KDM4A/JMJD2A | |
| siRNA | Commercially available from Dharmacon or Ambion |

3. Histone Methylation

| | |
|---|---|
| Setd2 | |
| siRNA | Commercially available from Dharmacon or Ambion |

In some embodiments, one or more of HDR, alt-HR, anti-HR, NHEJ, MMEJ, SSA, SSBR, MMR, NER, and BER are not substantially down-regulated. In some embodiments, only one DNA damage repair pathway is down-regulated.

VI.12 Additional Considerations in Selecting an HDR-Enhancer

In some embodiments, even though a component is typically recognized as participating in two pathways, it is possible to inhibit that component, resulting in inhibition of only one of the pathways. For example, in some embodiments, a component promotes a first pathway and inhibits a second pathway. In this embodiment, an inhibitor of the component would inhibit the first pathway but not the second. As a second example, in some embodiments, if a component is essential to a first pathway but redundant to a second pathway, inhibiting the component would inhibit the first pathway but not the second. As a third example, in some embodiments, a component may have a first activity that promotes a first pathway and a second activity that promotes a second pathway. In this embodiment, an inhibitor of the component's first activity would inhibit the first pathway but not the second. As a fourth example, in some embodiments, a component might act in a first pathway and a second pathway, and a low dose of an inhibitor inhibits the first pathway, and a higher dose of the inhibitor is necessary to inhibit the second pathway.

In some cases, the HDR-enhancer molecule is an antibody. Several commercially available antibodies for use in the methods disclosed herein are known in the art. It is understood that when using an antibody, and especially when administering the antibody to a human patient, one can use an antibody designed to minimize the patient's immune response against the antibody. For instance, a human antibody or a humanized antibody can be used. Methods of designing humanized antibodies are known in the art. It is also understood that one can use an antibody, or an antigen binding fragment thereof, that comprises CDRs (e.g., one or more of, e.g., all of CDRs HCDR1, HCDR2, HCDR3, LCDR1, LCDR2, and LCDR3, using the Kabat or Chothia definitions of CDRs) of an antibody described herein. The antibody can be, e.g., polyclonal or monoclonal, or an antigen binding portion thereof. The antibody can be, e.g., an IgG, IgM, IgA, IgD, or IgE molecule or an antigen-binding portion thereof. The antigen-binding portion may comprise a Fab, a F(ab')2, Fv, disulfide-linked F, scFv, single domain antibody, closed conformation multispecific antibody, disulfide-linked dscFV, or diabody. The antibody may be created by any suitable system; for example, it may be isolated from the serum of an animal, produced in a cell e.g., a hybridoma, a yeast cell, or a bacterial cell.

In some embodiments, the antibody is an intrabody. An intrabody is an antibody that can bind to an intracellular protein. To achieve intracellular localization, the introbody may comprise one or more localization moieties, e.g., a nuclear localization signal (NLS). In some embodiments the intrabody is produced in the cell that is its intended destination, e.g., the cell comprising the target nucleic acid to be edited. In other embodiments, the intrabody is produced in a host cell, e.g., a cultured cell, e.g., a mammalian, eukaryotic, or bacterial cell. In some embodiments, the intrabody comprises an scFv.

In some embodiments, the HDR-enhancer molecule is an siRNA. It is understood that when using a siRNA, and especially when administering the siRNA to a human patient, one can use a siRNA designed to promote the stability of the siRNA, for example by using chemically modified siRNA. Numerous modifications are known and are discussed in more detail in Section X herein. For instance, the siRNA may comprise one or more modified bases, modifications to the backbone, and/or moieties conjugated to the nucleic acid.

In some embodiments, the HDR-enhancer molecule is an HDR-enhancing gRNA. In some embodiments, the HDR-enhancing gRNA is used in combination with an eiCas9 molecule. In some embodiments, when the HDR-enhancing gRNA is used in combination with an eiCas9, the eiCas9 molecule will temporarily or transiently prevent and/or reduce transcription of the targeted gene in the cell, as compared to the level of transcription of the targeted gene in a cell that does not comprise the HDR-enhancing gRNA and eiCas9 molecule. Temporary inhibition of the targeted gene will allow the other Cas9 system to target the gene of interest and promote the repair of the target DNA via an HDR pathway, e.g., anti-HR, HR, and/or SSA. In some embodiments, the HDR-enhancing gRNA is used in combination with an eaCas9 molecule. In some embodiments, the HDR-enhancing gRNA is administered to the cell as a HDR-enhancing gRNA:Cas9 molecule complex.

In some embodiments, the HDR-enhancer molecule is an anti-MiR. An anti-MiR is an antisense nucleic acid that is capable of inhibiting a microRNA. In some embodiments, an anti-MiR is 100% complementary to the microRNA it targets, or a portion thereof. The anti-MiR may comprise RNA, and may comprise chemical modifications.

In some embodiments, HDR-enhancer has at least 60, 70, 80, 81, 82, 83, 84, 85, 86, 87, 88, 89, 90, 91, 92, 93, 94, 95, 97, 98, 99 or 100% homology with, or differs by no more than 50, 40, 30, 20, 15, 14, 13, 12, 11, 10, 9, 8, 7, 6, 5, 4, 3, 2, or 1, amino acid residues from a naturally occurring protein described herein, e.g., a protein of any of Tables VIA, VI.2, VI.4, VI.7, VI.9, VI.11, VI.13, VI.15, VI.17, and VI.18.

In some embodiments, the DNA damage response (DDR) pathway is not modulated. For example, in some embodiments, levels and activity of ATM, ATR, CHK1, and CHK2 are not altered. While not wishing to be bound by theory, in some embodiments leaving these components unaltered avoids certain side-effects.

In some embodiments, the HDR-enhancer modulates, e.g., inhibits, one or more of: ABL1, ATM, ATR, AURKB, BACH1, BARD1, BCCIP, BLM, BRCA2, BRCC3, BRE, BUB1B, C11orf30, CCNA2, CDC45, CDK1, CDK2, CDK4, CHEK1, CHEK2, DMC1, ECD, FANCD2, FANCE, FANCG, FANCI, FLNA, FYN, GRB2, H2AFX, HDAC1, HDAC2, HMG20B, KAT2B, KIF4A, LMNA, MCPH1, MGMT, MLH1, MLH3, MND1, MORF4L1, MRE11A, MSH4, MTA2, PALB2, PCNA, PDSSB, PLK1, PMS1, PMS2, PSMC3IP, PSMD3, PSMD6, RAD21, RAD23A, RAD50, RAD51, RAD51B, RAD51C, RBBP8, RPA1, RPA2, RPA3, SERPINH1, SHFM1, SIRT1, SIRT2, SKP2, SMAD1, SMAD2, SMAD3, SMC3, SP1, SPO11, STATSA, SYCP3, TEX15, TOP3A, TP53, UBC, UQCC1, USP11, WDR16, and XRCC3.

In some embodiments, the HDR-enhancer does not modulate, e.g., does not inhibit, one or more of: ABL1, ATM, ATR, AURKB, BACH1, BARD1, BCCIP, BLM, BRCA2, BRCC3, BRE, BUB1B, C11orf30, CCNA2, CDC45, CDK1, CDK2, CDK4, CHEK1, CHEK2, DMC1, ECD, FANCD2, FANCE, FANCG, FANCI, FLNA, FYN, GRB2, H2AFX, HDAC1, HDAC2, HMG20B, KAT2B, KIF4A, LMNA, MCPH1, MGMT, MLH1, MLH3, MND1, MORF4L1, MRE11A, MSH4, MTA2, PALB2, PCNA, PDSSB, PLK1, PMS1, PMS2, PSMC3IP, PSMD3, PSMD6, RAD21, RAD23A, RAD50, RAD51, RAD51B, RAD51C, RBBP8, RPA1, RPA2, RPA3, SERPINH1, SHFM1, SIRT1, SIRT2, SKP2, SMAD1, SMAD2, SMAD3, SMC3, SP1, SPO11, STATSA, SYCP3, TEX15, TOP3A, TP53, UBC, UQCC1, USP11, WDR16, and XRCC3.

VI.13 Promoting HDR by Modulating the Cell Cycle

Since the HDR machinery is active during G2, in some aspects, the present disclosure provides methods of promoting HDR by increasing the proportion of cells in G2, e.g., by administering an agent that arrests cells in G2. In some embodiments, this agent induces reversible cell cycle arrest, so that cells can divide normally once the inhibitor is no longer effective. The agent may be, e.g., an inhibitor of a cyclin-dependent kinase, e.g., an inhibitor of CDK1. Inhibition of Cdk1 can arrest reversibly cells at the G2/M boundary. Exemplary cell cycle arrest agents are provided in Table VIII below.

TABLE VI.20

Cell cycle arrest agents.
1. Cdk1

| Compounds | Reference(s) |
|---|---|
| RO-3306 | Vassilev et al. (2006) PROC. NAT'L. ACAD. SCI. USA 103(28): 10660-5. |
| AZD 5438 | Camidge et al. (2006) Cancer Chemother. Pharmacol. 60(4): 479-88. |

In some embodiments, a cell is treated with a cell cycle arrest agent in combination with another HDR-enhancer, e.g., an HDR-enhancer as described in one or more of Sections VI.1 through VI.13 above.

VII. Creating Mutations, e.g., Deletions, by Promoting Error-Prone DNA Repair

The present disclosure provides, e.g., compositions and methods for creating mutations, e.g., deletions, in a target region. In some embodiments, a mutation, e.g., deletion is created by making a Cas9-mediated break at the location where the deletion is desired, and inhibiting a DNA damage repair pathway so that the break is repaired by an error-prone pathway such as alt-NHEJ. In the wild-type context, alt-NHEJ occurs when there is a small degree of resection at the break. (When there is no resection, canonical NHEJ is favored, and when there is a large degree of resection, HDR or SSA is favored.) Accordingly, in the methods described in this section, it is often desirable to induce a short amount of resection.

Generally, in order to promote alt-NHEJ, one does not provide a template nucleic acid, because a template nucleic acid causes a cell to favor HDR over alt-NHEJ.

In some embodiments, the error-prone pathway is promoted by down-regulating HDR. Down-regulators of HDR are listed herein, e.g., in Section VI.1, e.g., in Table VI.3. In some embodiments, the methods herein involve down-regulating an HDR pathway, in the absence of a template nucleic acid, in order to promote alt-NHEJ. For instance, the methods may involve modulating, e.g., inhibiting, a component (e.g., exactly one component, or one or more components, e.g., two or three components) of an HDR pathway, e.g., a component of Table VI.1(C) or VI.2. In some embodiments, HDR is down-regulated using an agent of Table VI.3. In embodiments where HDR is inhibited, this disclosure contemplates inhibiting downstream components of HDR, e.g., BRCA2 and/or RAD51. In some embodiments, BRCA1 is inhibited, in order to result in a loss of resection, to up-regulate the NHEJ pathway (see, e.g., Cotta-Ramusino et al. (2011) SCIENCE 332(6035): 1313-7). In some embodiments, upstream components of HDR, e.g., one or more pro-resection proteins, e.g., exonucleases, are not inhibited.

In some embodiments, resection is promoted by inhibiting an anti-resection protein. Down-regulators of anti-resection proteins are listed, e.g., in Section VI.4, e.g., in Table VI.8. Accordingly, in some embodiments, a cell is treated with a (e.g., exactly one, or one or more) inhibitor of an anti-resection protein.

In embodiments, resection is promoted by providing a protein that promotes resection, e.g., an exonuclease. In some embodiments, the method comprises providing (e.g., by overexpressing) MRE11, NBS1, BRCA1-C, CtIP, MRN, EXO1, BLM, or DNA2 endonuclease.

The method of creating a deletion may be used during any time that the alt-NHEJ machinery is active, e.g., in G1, S, or G2 phase.

In some embodiments, a mutation, e.g., a deletion, is created by making a Cas9-mediated break at the location where the deletion is desired, and inhibiting a DNA damage repair pathway so that the break is repaired by an error-prone pathway, e.g., C-NHEJ. While not wishing to be bound by theory, in some embodiments, inhibition of BRCA2 and Rad51 decreases other HDR pathways without perturbing resection, and therefore the SSA repair pathway becomes more dominant (see, e.g., Cotta-Ramusino et al. (2011); and Stark et al. (2004) MOL. CELL BIOL. 24(21): 9305-16).

In some embodiments, the error prone pathway that is promoted is SSA. In some embodiments, a template nucleic acid is not provided to resolve a DNA lesion because a template nucleic acid causes a cell to favor other HDR pathways over SSA. Thus, in some embodiments, one HDR pathway is perturbed, and no template nucleic acid is provided, in order promote SSA. In addition, in some embodiments, a cell is treated with an up-regulator (e.g., exactly one up-regulator, or one or more up-regulators) of SSA. In embodiments, EPR-enhancer has at least 60, 70, 80, 81, 82, 83, 84, 85, 86, 87, 88, 89, 90, 91, 92, 93, 94, 95, 96, 97, 98, 99 or 100% homology with, or differs by no more than 50, 40, 30, 20, 15, 14, 13, 12, 11, 10, 9, 8, 7, 6, 5, 4, 3, 2, or 1, amino acid residues from a naturally occurring protein described herein, e.g., a protein of any of Table VI.11 which lists components of the SSA pathway.

In some embodiments, a cell is treated with a down-regulator (e.g., exactly one down-regulator, or one or more down-regulators) of HDR.

In some embodiments, the SDMMJ pathway is down-regulated in order to promote SSA. For instance, DNA polymerase theta (Pol Theta) can be inhibited in order to down-regulate SDMMJ. Experiments that abrogate Pol Theta expression result in larger deletions, a phenotype that resembles SSA. Accordingly, in some embodiments, a cell is treated with a down-regulator (e.g., exactly one down-regulator, or one or more down-regulators) of SDMMJ.

In one embodiment, the EPR enhancer is an siRNA. In another embodiment, the EPR enhancer is an antibody, e.g., an intrabody. In another embodiment, the EPR enhancer is an EPR-enhancing gRNA. As used herein, the term "EPR-enhancing gRNA" refers to a gRNA, which, in combination with a Cas9 molecule (e.g., an eiCas9 molecule), enhances (e.g., increases the frequency or efficiency of) error-prone repair (e.g., alt-NJEH and SSA). In some embodiments, the EPR-enhancing gRNA guides a Cas9-mediated reduction in the transcription of a gene encoding a non-error-prone DNA damage repair pathway protein. In some embodiments, the EPR-enhancing gRNA guides a Cas9-mediated cleavage event in a gene encoding a non-error-prone DNA damage repair pathway protein (e.g., a protein involved in HDR, such as HR, alt-HR, and/or SSA).

The methods in this section may be used in a variety of contexts. For example, they may be used to, e.g., inactivate a preselected gene in a model organism in order to study the gene. In addition, the methods may be used to inactivate a gene that causes disease, e.g., an oncogene or a gene of a pathogen (e.g., a viral gene that has integrated into a host cell's genome, a protease, a polymerase, a structural gene, a bacterial gene, a toxin, a cell wall synthesis gene, or a drug resistance gene).

VIII. Target Cells

Cas9 molecules and gRNA molecules, e.g., a Cas9 molecule/gRNA molecule complex, as disclosed herein, can be used to manipulate e.g., to edit a target nucleic acid, a wide variety of cells. Additional details on types of cells that can be manipulated may be found in the section entitled "VIIA. TARGETS: CELLS" of PCT Application WO2015/048577, the entire contents of which are expressly incorporated herein by reference.

In some embodiments, a cell, or a population of cells, is manipulated by editing (e.g., introducing a mutation or correcting) one or more target genes, e.g., as described herein. In an embodiment, a cell, or a population of cells, is manipulated by editing one or more non-coding sequences, e.g., an alteration in an intron or in a 5' or 3' non-translated or non-transcribed region. In an embodiment, a cell is manipulated by editing the sequence of a control element, e.g., a promoter, enhancer, or a cis-acting or trans-acting control element. In an embodiment, a cell, or a population of cells, is manipulated by editing one or more coding sequences, e.g., an alteration in an exon. In some embodiments, a cell, or a population of cells, is manipulated in vitro. In other embodiments, a cell, or a population of cells, is manipulated ex vivo. In some embodiments, a cell, or a population of cells, is manipulated in vivo. In some embodiments, the expression of one or more target genes (e.g., one or more target genes described herein) is modulated, e.g., in vivo. In other embodiments, the expression of one or more target genes (e.g., one or more target genes described herein) is modulated, e.g., ex vivo. In other embodiments, the expression of one or more target genes (e.g., one or more target genes described herein) is modulated, e.g., in vitro.

In some embodiments, the cell, or population of cells, is a T cell, e.g., a CD8$^+$ T cell (e.g., a CD8$^+$ naïve T cell, central memory T cell, or effector memory T cell), a CD4$^+$ T cell, a stem cell memory T cell, a helper T cell, a regulatory T cell, a cytotoxic T cell, a natural killer T cell, or a population of such cells.

In some embodiments, the cell, or population of cells, is a Hematopoietic Stem Cell (e.g., a long term hematopoietic stem cell (LT-HSC), a short term hematopoietic stem cell (ST-HSC), a multipotent progenitor (MPP) cell, a lineage restricted progenitor (LRP) cell (e.g., a lymphoid progenitor cell, a myeloid progenitor cell (e.g., a common myeloid progenitor (CMP) cell), an erythroid progenitor cell (e.g., a megakaryocyte erythroid progenitor (MEP) cell)), or a population of such cells.

In some embodiments, the cell, or population of cells, is a retinal cell (e.g., a photoreceptor cell (e.g., a rod cell, a cone cell) a retinal pigmented epithelium (RPE) cell), a trabecular meshwork cell, or a population of such cells.

In some embodiments, the cell, or population of cells, is a cochlear hair cell (e.g., an outer hair cell or an inner hair cell), or a population of cochlear hair cells.

In some embodiments, the cell, or population of cells, is a pulmonary epithelial cell (e.g., a bronchial epithelial cell or an alveolar epithelial cell), a pulmonary epithelial progenitor cell, or a population of such cells.

In some embodiments, the cell, or population of cells, is a striated muscle cell, a cardiac muscle cell, a muscle satellite cell, or a population of such cells.

In some embodiments, the cell, or population of cells, is a neuron, a neuronal stem cell, or a population of such cells.

In some embodiments, the cell, or population of cells, is a mesenchymal stem cell, or a population of mesenchymal stem cells.

In some embodiments, the cell, or population of cells, is an induced pluripotent stem (iPS) cell, or a population of iPS cells.

In some embodiments, the cell, or population of cells, is an embryonic stem cell, or a population of embryonic stem cells.

In some embodiments, the cell, or population of cells, is a monocyte, a megakaryocyte, a neutrophil, an eosinophil, a basophil, a mast cell, a reticulocyte, or a population of such cells.

In some embodiments, the cell, or population of cells, is a B cell, e.g., a progenitor B cell, a Pre B cell, a Pro B cell, a memory B cell, or a plasma B cell, or a population of B cells.

In some embodiments, the cell, or population of cells, is a gastrointestinal epithelial cell, a biliary epithelial cell, a pancreatic ductal epithelial cell, an intestinal stem cell, or a population of such cells.

In some embodiments, the cell, or population of cells, is a hepatocyte, a liver stellate cell, a Kupffer cell, or a population of such cells.

In some embodiments, the cell, or population of cells, is an osteoblast, an osteoclast, or a population of such cells.

In some embodiments, the cell, or population of cells, is an adipocyte, a preadipocyte, or a population of such cells.

In some embodiments, the cell, or population of cells, is a pancreatic islet cell (e.g., a beta cell, an alpha cell, or a delta cell), a pancreatic exocrine cell, or a population of such cells.

In some embodiments, the cell, or population of cells, is a Schwann cell, an oligodendrocyte, or a population of such cells.

In some embodiments, the cells are manipulated (e.g., converted or differentiated) from one cell type to another. In some embodiments, a pancreatic cell is manipulated into a beta islet cell. In some embodiments, a fibroblast is manipulated into an iPS cell. In some embodiments, a preadipocyte is manipulated into a brown fat cell. Other exemplary cells include, e.g., muscle cells, neural cells, leukocytes, and lymphocytes. In some embodiments, the cell being manipulated is selected from fibroblasts, monocytic precursors, B cells, exocrine cells, pancreatic progenitors, endocrine progenitors, hepatoblasts, myoblasts. In some embodiments, the cell is manipulated (e.g., converted or differentiated) into muscle.

In some embodiments, a nucleic acid at one or more target positions in a cell, or a population of cells, is altered e.g., as described herein. In some embodiments, a nucleic acid at one or more target positions in a cell, or a population of cells (e.g., target positions at one or more genes described herein) is altered, e.g., in vivo. In other embodiments, a nucleic acid at one or more target positions in a cell, or a population of cells (e.g., target positions at one or more genes described herein) is altered, e.g., ex vivo. The Cas9 molecule, nucleic acid template system, and/or gRNA molecules described herein can be delivered to a cell or to a population of cells.

In some embodiments, the cell, or the population of cells, is a T cell, a $CD8^+$ T cell, a $CD8^+$ naïve T cell, a central memory T cell, an effector memory T cell, a $CD4^+$ T cell, a stem cell memory T cell, a helper T cell, a regulatory T cell, a cytotoxic T cell, a natural killer T cell, a hematopoietic stem cell, a long term hematopoietic stem cell, a short term hematopoietic stem cell, a multipotent progenitor cell, a lineage restricted progenitor cell, a lymphoid progenitor cell, a pancreatic progenitor cell, an endocrine progenitor cell, an exocrine progenitor cell, a myeloid progenitor cell, a common myeloid progenitor cell, an erythroid progenitor cell, a megakaryocyte erythroid progenitor cell, a monocytic precursor cell, an endocrine precursor cell, an exocrine cell, a fibroblast, a hepatoblast, a myoblast, a macrophage, an islet beta-cell, a cardiomyocyte, a blood cell, a ductal cell, an acinar cell, an alpha cell, a beta cell, a delta cell, a PP cell, a cholangiocyte, a retinal cell, a photoreceptor cell, a rod cell, a cone cell, a retinal pigmented epithelium cell, a trabecular meshwork cell, a cochlear hair cell, an outer hair cell, an inner hair cell, a pulmonary epithelial cell, a bronchial epithelial cell, an alveolar epithelial cell, a pulmonary epithelial progenitor cell, a striated muscle cell, a cardiac muscle cell, a muscle satellite cell, a myocyte, a neuron, a neuronal stem cell, a mesenchymal stem cell, an induced pluripotent stem (iPS) cell, an embryonic stem cell, a monocyte, a megakaryocyte, a neutrophil, an eosinophil, a basophil, a mast cell, a reticulocyte, a B cell, e.g. a progenitor B cell, a Pre B cell, a Pro B cell, a memory B cell, a plasma B cell, a gastrointestinal epithelial cell, a biliary epithelial cell, a pancreatic ductal epithelial cell, an intestinal stem cell, a hepatocyte, a liver stellate cell, a Kupffer cell, an osteoblast, an osteoclast, an adipocyte (e.g., a brown adipocyte, or a white adipocyte), a preadipocyte, a pancreatic precursor cell, a pancreatic islet cell, a pancreatic beta cell, a pancreatic alpha cell, a pancreatic delta cell, a pancreatic exocrine cell, a Schwann cell, or an oligodendrocyte, or a population of such cells.

In some embodiments, the cell, or the population of cells, is a mammalian cell, e.g., a human cell, a mouse cell, a rat cell, a sheep cell, a cow cell, a pig cell, a horse cell, a goat cell, a dog cell or a cat cell, or a population of mammalian cells. In one embodiment, the cell is a human cell.

In an embodiment, the cell, or population of cells, is manipulated ex vivo by altering a nucleic acid at one or more target positions, and administered to a subject. A cell, or population of cells, to be altered according to the methods disclosed herein, may include a stem cell such as, by way of example, an embryonic stem cell, an induced pluripotent stem cell or a neuronal stem cell, or a population of such cells. In an embodiment, the cell, or population of cells, is an induced pluripotent stem (iPS) cell or a cell derived from an iPS cell, or a population of such cells, altered to correct a mutation and differentiated into a clinically relevant cell, or population of cells.

In some embodiments, the cell is a cell from a disease-causing organism, e.g., a bacterium, fungus, protozoan, or parasite. In some embodiments, the cell is a cell infected with a disease-causing organism (e.g., a virus, fungus, protozoan, or parasite).

In some embodiments, the cell is situated in the body of a subject. In such instances, the cell might be the subject's own cells or might be a cell of a disease-causing organism. In this case, a gRNA molecule, a Cas9 molecule, and a nucleic acid template system, may be administered to the subject as pharmaceutical compositions. In some embodiments, the subject is a mammal, e.g., a human, a farm animal (e.g., a cow, a pig, a horse, or a goat), or a companion animal (e.g., a dog or a cat).

In some embodiments, the subject suffers from a disease caused by a target position in a nucleic acid, e.g., a particular mutation, of a cell, or population of cells.

In some embodiments, the cell, or population of cells, is a diseased or mutant-bearing cell, or population of cells. Such cells can be altered to treat the disease, e.g., to correct a mutation, or to alter the phenotype of the cell, or population of cells, e.g., to inhibit the growth of a cancer cell or a population of cancer cells, e.g., a tumor. For example, a cell, or a population of cells, is associated with one or more diseases or conditions describe herein. In some embodiments, the cell is a cancer stem cell. For example, cancer stem cells can be manipulated by modulating the expression of one or more genes selected from TWIST (TF), HIF-1 alpha, HER2/neu, Snail (TF), or Wnt. In some embodiments, the cancer cell is selected from lung cancer cells, breast cancer cells, skin cancer cells, brain cancer cells, pancreatic cancer cells, hematopoietic cancer cells, liver cancer cells, kidney cancer cells, and ovarian cancer cells.

In some embodiments, the cell is characterized by a disorder caused by aberrant mtDNA. This disorder may be, e.g., a mtDNA depletion syndrome (e.g., Alpers or early infantile hepatocerebral syndromes) or a mtDNA deletion disorder (e.g., progressive external ophthalmoplegia (PEO), ataxia-neuropathy, or mitochondrial neurogastrointestinal encephalomyopathy (MNGIE)).

In some embodiments, the cell, or population of cells, is a normal cell or a population of normal cells.

In some embodiments, the cell, or population of cells, is a stem cell or a progenitor cell (e.g., iPS, embryonic, hematopoietic, adipose, germline, lung, or neural stem or progenitor cells), or a population of such cells.

The cells may also be treated at a time when they are not situated in the body of a subject. In some embodiments, a cell, or a population of cells, is treated ex vivo to avoid exposing a patient to an agent or agents that cause undesirable side effects. In some embodiments, treating cells ex vivo allows a user to select a sub-population of cells to administer to the patient. The sub-population may be, e.g., cells having a nucleic acid that was successfully altered, or cells having a desired phenotype, such as minimal undesired alterations to DNA, or a phenotype that indicates the nucleic acid was successfully altered.

In some embodiments, the cell, or population of cells, is not situated in a subject's body and the cell, or population of cells, is modified for research or manufacturing purposes. In some embodiments, the cell, or population of cells, is suitable for producing a recombinant biological product. For example, the cell, or population of cells, can be a CHO cell or a fibroblast. In one embodiment, the cell, or population of cells, is a cell, or population of cells, that has been engineered to express a protein.

In some embodiments, the cell, or population of cells, is not actively dividing. In some embodiments, the cell is in in G0 phase (which is sometimes viewed as a prolonged G1 phase), is quiescent, or is senescent. In some embodiments, the population of cells are in G0 phase, are quiescent, or are senescent. In some embodiment, the quiescent cell can be a terminally differentiated cell. In some embodiments, the quiescent cell can be a neuron, a muscle cell, e.g., a cardiac muscle cell, a parenchymal cell e.g., a parenchymal liver or kidney cell, a hematopoietic cell e.g., a hematopoetic stem cell, a fibroblast, a stem cell e.g., an adult stem cell, a hepatic cell e.g., a hepatic stellate cell, an immune cell e.g., a T cell or B cell, or an epithelial cell. In some embodiments, the senescent cell may have shortened telomeres relative to an actively dividing cell, e.g., its telomeres may be of a length that triggers a halt in the cell cycle.

In some embodiments, the cell, or population of cells, is characterized by a disorder caused by aberrant mtDNA. This disorder may be, e.g., a mtDNA depletion syndrome (e.g., Alpers or early infantile hepatocerebral syndromes) or mtDNA deletion disorder (e.g., progressive external ophthalmoplegia (PEO), ataxia-neuropathy, or mitochondrial neurogastrointestinal encephalomyopathy (MNGIE)).

In some embodiments, the cell, or population of cells, is actively dividing. In some embodiments, the cell is in G2 phase. In some embodiments, the population of cells comprises cells that are in G2 phase. In some embodiments, the cell is in G1 phase. In some embodiments, the population of cells comprises cells that are in G1 phase. In some embodiments, the cell is in S phase. In some embodiments, the population of cells comprises cells that are in S phase.

The technology described herein can be used to edit numerous types of genomes, including plant genomes. The CRISPR/Cas system has been used for plant genome editing, as has been described in, e.g., Belhaj et al., PLANT METHODS 9:39, 2013. Plant cells can carry out HDR, so a Cas9-induced nick or DSB can be repaired by HDR. Plant cells also have NHEJ machinery, and in some embodiments, NHEJ is inhibited, resulting in stimulation of HDR. Accordingly, in certain embodiments, the cell, or the population of cells, is a plant cell, e.g., a monocot plant cell, or a dicot plant cell, or a population of plant cell. In certain embodiments, the plant is a crop, e.g., a food crop. In certain embodiments, the plant is rice (e.g., *Orzya sativa*), maize (e.g., *Zea mays*), wheat (e.g., *Triticum aestivum*), soy (e.g., *Glycine max*), potato (e.g., *Solanum tuberosum*), a species of *Nicotiana*, a species of *Arabidopsis* e.g., *Arabidopsis thaliana*, cassava, sweet potato, sorghum, yam, plantain, or a citrus plant. In some embodiments, the plant is a pesticide-resistant plant, e.g., a plant that expresses one or more genes that confer resistance to a pesticide. In some embodiments, the plant is herbicide-resistant plant, e.g., a plant that expresses one or more genes that confer resistance to a herbicide. The herbicide may be, e.g., Roundup® (also known as glyphosate or N-(phosphonomethyl)glycine). In some embodiments, the plant produces a pesticide, e.g., Bt.

In some embodiments, the components used in the methods described herein (e.g., a Cas9 molecule and a gRNA) are introduced into the plant cell via protoplast transformation or agroinfiltration.

In some embodiments, after genome editing using the methods described herein, seeds are screened and a desired sub-population of seeds are selected. The sub-population may be, e.g., cells having a nucleic acid that was successfully altered, or cells having a desired phenotype such as minimal undesired alterations to DNA, or a phenotype that indicates the nucleic acid was successfully altered.

IX. Delivery, Formulations and Routes of Administration

The components, e.g., a Cas9 molecule and gRNA molecule can be delivered or formulated in a variety of forms, see, e.g., Tables IX.1-IX.3. When a Cas9 or gRNA component is encoded as DNA for delivery, the DNA will typically but not necessarily include a control region, e.g., comprising a promoter, to effect expression. Useful promoters for Cas9 molecule sequences include CMV, EF-1 alpha, MSCV, PGK, CAG control promoters. Useful promoters for gRNAs include H1, EF-1alpha and U6 promoters. Promoters with similar or dissimilar strengths can be selected to tune the expression of components. Sequences encoding a Cas9 molecule can comprise a nuclear localization signal (NLS), e.g., an SV40 NLS. In an embodiment a promoter for a Cas9 molecule or a gRNA molecule can be, independently, inducible, tissue specific, or cell specific.

Table IX.1 provides non-limiting examples of the form in which the components can be delivered to a target cell. Merged cells indicate that the components of those columns are delivered via the same molecule, e.g., in the second row, the gRNA and the donor template nucleic acid are delivered on the same DNA molecule as indicated by the two merged cells.

TABLE IX.1

| Cas9 Molecule(s) | gRNA Molecule(s) | Donor Template Nucleic Acid | Comments |
|---|---|---|---|
| DNA | DNA | DNA | In this embodiment, a Cas9 molecule, typically an eaCas9 molecule, and a gRNA are transcribed from DNA. In this embodiment, they are encoded on separate molecules. In this embodiment, the donor template is provided as a separate DNA molecule. |
| DNA | DNA | | In this embodiment, a Cas9 molecule, typically an eaCas9 molecule, and a gRNA are transcribed from DNA. In this embodiment, they are encoded on separate molecules. In this embodiment, the donor template is provided on the same DNA molecule that encodes the gRNA. |
| | DNA | DNA | In this embodiment, a Cas9 molecule, typically an eaCas9 molecule, and a gRNA are transcribed from DNA, here from a single molecule. In this embodiment, the donor template is provided as a separate DNA molecule. |
| DNA | DNA | DNA | In this embodiment, a Cas9 molecule, typically an eaCas9 molecule, and a gRNA are transcribed from DNA. In this embodiment, they are encoded on separate molecules. In this embodiment, the donor template is provided on the same DNA molecule that encodes the Cas9. |
| DNA | RNA | DNA | In this embodiment, a Cas9 molecule, typically an eaCas9 molecule, is transcribed from DNA, and a gRNA is provided as an RNA, e.g., as in vitro transcribed or synthesized RNA. In this embodiment, the donor template is provided as a separate DNA molecule. |
| DNA | RNA | DNA | In this embodiment, a Cas9 molecule, typically an eaCas9 molecule, is transcribed from DNA, and a gRNA is provided as an RNA, e.g., as in vitro transcribed or synthesized RNA. In this embodiment, the donor template is provided on the same DNA molecule that encodes the Cas9. |
| mRNA | RNA | DNA | In this embodiment, a Cas9 molecule, typically an eaCas9 molecule, is translated from in vitro transcribed or synthesized mRNA, and a gRNA is provided as an RNA, e.g., as in vitro transcribed or synthesized RNA. In this embodiment, the donor template is provided as a DNA molecule. |
| mRNA | DNA | DNA | In this embodiment, a Cas9 molecule, typically an eaCas9 molecule, is translated from in vitro transcribed or synthesized mRNA, and a gRNA is transcribed from DNA. In this embodiment, the donor template is provided as a separate DNA molecule. |
| mRNA | DNA | | In this embodiment, a Cas9 molecule, typically an eaCas9 molecule, is translated from in vitro transcribed or synthesized mRNA, and a gRNA is transcribed from DNA. In this embodiment, the donor template is provided on the same DNA molecule that encodes the gRNA. |
| Protein | DNA | DNA | In this embodiment, a Cas9 molecule, typically an eaCas9 molecule, is provided as a protein, and a gRNA is transcribed from DNA. In this embodiment, the donor template is provided as a separate DNA molecule. |
| Protein | DNA | | In this embodiment, a Cas9 molecule, typically an eaCas9 molecule, is provided as a protein, and a gRNA is transcribed from DNA. In this embodiment, the donor template is provided on the same DNA molecule that encodes the gRNA. |
| Protein | RNA | DNA | In this embodiment, an eaCas9 molecule is provided as a protein, and a gRNA is provided as transcribed or synthesized RNA. In this embodiment, the donor template is provided as a DNA molecule. |

In some embodiments, a nucleic acid encoding an HDR-enhancer molecule is on a separate nucleic acid molecule from other components being delivered (e.g., gRNAs, Cas9 molecule, or template nucleic acid). In some embodiments, a DNA encoding an HDR-enhancer molecule is part of a DNA molecule encoding one or more, e.g., all, of a gRNA or a Cas9 molecule or comprising a template nucleic acid. In some embodiments, a DNA encoding an HDR-enhancer molecule is part of a DNA molecule listed in Table IX.1.

Other delivery combinations are illustrated in Table IX.2

TABLE IX.2

| Cas9 Molecule(s) | gRNA Molecule(s) | Donor Template Nucleic Acid | HDR-enhancer | Comments |
|---|---|---|---|---|
| DNA | DNA | DNA | DNA | |
| | DNA | DNA | DNA | |
| DNA | | DNA | DNA | |
| DNA | DNA | | DNA | |
| DNA | DNA | DNA | DNA | In this embodiment, the gene for the Cas9 molecule and the template nucleic acid are provided on the same DNA molecule. |
| DNA | DNA | DNA | DNA | In this embodiment, the gene for the Cas9 molecule and the gene for the HDR enhancer are provided on the same DNA molecule. |

TABLE IX.2-continued

| | | Elements | | |
|---|---|---|---|---|
| Cas9 Molecule(s) | gRNA Molecule(s) | Donor Template Nucleic Acid | HDR-enhancer | Comments |
| DNA | DNA | DNA | DNA | In this embodiment, the gene for the gRNA molecule and the template nucleic acid are provided on the same DNA molecule. |
| DNA | DNA | DNA | DNA | In this embodiment, the template nucleic acid and the gene for the HDR enhancer are provided on the same DNA molecule. |
| DNA | DNA | DNA | DNA | |
| DNA | DNA | DNA | DNA | In this embodiment, the gene for the Cas9 molecule, the template nucleic acid, and the gene for the HDR-enhancer are provided on the same DNA molecule. |
| DNA | DNA | DNA | DNA | In this embodiment, the gene for the Cas9 molecule, the template nucleic acid, the gene for the gRNA, and the gene for the HDR-enhancer are provided on the same DNA molecule. |
| DNA | RNA | DNA | DNA | In these embodiments, the Cas9 gene, template nucleic acid, and HDR enhancer can be provided on the same DNA molecule, on three different DNA molecules, or any two of the components can be on a first DNA molecule and the third component can be on another DNA molecule. |
| DNA | RNA | DNA | mRNA | In these embodiments, the Cas9 gene and template nucleic acid can be on the same DNA molecule or on different DNA molecules. |
| DNA | RNA | DNA | Protein, small molecule, or siRNA | In these embodiments, the Cas9 gene and template nucleic acid can be on the same DNA molecule or on different DNA molecules. |
| mRNA | RNA | DNA | DNA | In these embodiments, the template nucleic acid and HDR-enhancer can be on the same DNA molecule or on different DNA molecules. |
| mRNA | RNA | DNA | mRNA | |
| mRNA | RNA | DNA | Protein, small molecule, or siRNA | |
| mRNA | DNA | DNA | DNA | In these embodiments, the gRNA gene, template nucleic acid, and HDR enhancer gene can be provided on the same DNA molecule, on three different DNA molecules, or any two of the components can be on a first DNA molecule and the third component can be on another DNA molecule. |
| mRNA | DNA | DNA | mRNA | In these embodiments, the gRNA gene and template nucleic acid can be on the same DNA molecule or on different DNA molecules. |
| mRNA | DNA | DNA | Protein, small molecule, or siRNA | In these embodiments, the gRNA gene and template nucleic acid can be on the same DNA molecule or on different DNA molecules. |
| Protein | DNA | DNA | DNA | In these embodiments, the gRNA gene, template nucleic acid, and HDR-enhancer gene can be |

TABLE IX.2-continued

| Cas9 Molecule(s) | gRNA Molecule(s) | Donor Template Nucleic Acid | HDR-enhancer | Comments |
|---|---|---|---|---|
| | | | | provided on the same DNA molecule, on three different DNA molecules, or any two of the components can be on a first DNA molecule and the third component can be on another DNA molecule. |
| Protein | DNA | DNA | mRNA | In these embodiments, the gRNA gene and template nucleic acid can be on the same DNA molecule or on different DNA molecules. |
| Protein | DNA | DNA | Protein, small molecule, or siRNA | In these embodiments, the gRNA gene and template nucleic acid can be on the same DNA molecule or on different DNA molecules. |
| Protein | RNA | DNA | DNA | In these embodiments, the template nucleic acid and HDR-enhancer gene can be on the same DNA molecule or on different DNA molecules. |
| Protein | RNA | DNA | mRNA | |
| Protein | RNA | DNA | Protein, small molecule, or siRNA | |

Table IX.3 summarizes various delivery methods for the components of a Cas system, e.g., the Cas9 molecule component and the gRNA molecule component, as described herein.

TABLE IX.3

| | Delivery Vector/Mode | Delivery into Non-Dividing Cells | Duration of Expression | Genome Integration | Type of Molecule Delivered |
|---|---|---|---|---|---|
| | Physical (e.g., electroporation, particle gun, calcium phosphate transfection) | YES | Transient | NO | Nucleic Acids and Proteins |
| Viral | Retrovirus | NO | Stable | YES | RNA |
| | Lentivirus | YES | Stable | YES/NO with modifications | RNA |
| | Adenovirus | YES | Transient | NO | DNA |
| | Adeno-Associated Virus (AAV) | YES | Stable | NO | DNA |
| | Vaccinia Virus | YES | Transient | NO | DNA |
| | Herpes Simplex Virus | YES | Stable | NO | DNA |
| Non-Viral | Cationic Liposomes | YES | Transient | Depends on what is delivered | Nucleic Acids and Proteins |
| | Polymeric Nanoparticles | YES | Transient | Depends on what is delivered | Nucleic Acids and Proteins |
| Biological Non-Viral Delivery Vehicles | Attenuated Bacteria | YES | Transient | NO | Nucleic Acids |
| | Engineered Bacteriophages | YES | Transient | NO | Nucleic Acids |
| | Mammalian Virus-like Particles | YES | Transient | NO | Nucleic Acids |

TABLE IX.3-continued

| Delivery Vector/Mode | Delivery into Non-Dividing Cells | Duration of Expression | Genome Integration | Type of Molecule Delivered |
|---|---|---|---|---|
| Biological liposomes: Erythrocyte Ghosts and Exosomes | YES | Transient | NO | Nucleic Acids |

DNA-Based Delivery of a Cas9 Molecule and or a gRNA Molecule

DNA encoding Cas9 molecules (e.g., eaCas9 molecules), gRNA molecules, template nucleic acids, and/or HDR-enhancers, can be administered to subjects or delivered into cells by any appropriate method, e.g., by art-known methods or as described herein. For example, Cas9-encoding and/or gRNA-encoding DNA can be delivered, e.g., by vectors (e.g., viral or non-viral vectors), non-vector based methods (e.g., using naked DNA or DNA complexes), or a combination thereof.

In some embodiments, the nucleic acid, e.g., Cas9-, gRNA-, and/or HDR-enhancer-encoding DNA is delivered by a vector (e.g., viral vector/virus or plasmid).

In one embodiment, a vector can comprise a sequence that encodes a Cas9 molecule, a gRNA molecule, and/or an HDR-enhancer. In one embodiment, a vector can also comprise a sequence encoding a signal peptide (e.g., for nuclear localization, nucleolar localization, mitochondrial localization), fused, e.g., to a Cas9 molecule sequence. For example, a vector can comprise a nuclear localization sequence (e.g., from SV40) fused to the sequence encoding the Cas9 molecule.

One or more regulatory/control elements, e.g., a promoter, an enhancer, an intron, a polyadenylation signal, a Kozak consensus sequence, internal ribosome entry sites (IRES), a 2A sequence, and splice acceptor or donor can be included in the vectors. In some embodiments, the promoter is recognized by RNA polymerase II (e.g., a CMV promoter).

In some embodiments, the vector or delivery vehicle is a viral vector (e.g., for generation of recombinant viruses). In some embodiments, the virus is a DNA virus (e.g., dsDNA or ssDNA virus). In other embodiments, the virus is an RNA virus (e.g., an ssRNA virus). Exemplary viral vectors/viruses include, e.g., retroviruses, lentiviruses, adenovirus, adeno-associated virus (AAV), vaccinia viruses, poxviruses, and herpes simplex viruses.

In some embodiments, the virus infects dividing cells. In other embodiments, the virus infects non-dividing cells. In some embodiments, the virus infects both dividing and non-dividing cells. In some embodiments, the virus can integrate into the host genome. In some embodiments, the virus is engineered to have reduced immunity, e.g., in human. In some embodiments, the virus is replication-competent. In other embodiments, the virus is replication-defective, e.g., having one or more coding regions for the genes necessary for additional rounds of virion replication and/or packaging replaced with other genes or deleted. In some embodiments, the virus causes transient expression of the Cas9 molecule and/or the gRNA molecule. In other embodiments, the virus causes long-lasting, e.g., at least 1 week, 2 weeks, 1 month, 2 months, 3 months, 6 months, 9 months, 1 year, 2 years, or permanent expression, of the Cas9 molecule and/or the gRNA molecule. The packaging capacity of the viruses may vary, e.g., from at least about 4 kb to at least about 30 kb, e.g., at least about 5 kb, 10 kb, 15 kb, 20 kb, 25 kb, 30 kb, 35 kb, 40 kb, 45 kb, or 50 kb.

In some embodiments, the Cas9-, gRNA-, and/or HDR-enhancer-encoding DNA is delivered by a recombinant adenovirus. In some embodiments, the adenovirus is engineered to have reduced immunity in human.

In some embodiments, the Cas9- and/or gRNA-encoding DNA is delivered by a recombinant AAV. In some embodiments, the AAV can incorporate its genome into that of a host cell, e.g., a target cell as described herein. In some embodiments, the AAV is a self-complementary adeno-associated virus (scAAV), e.g., a scAAV that packages both strands which anneal together to form double stranded DNA. AAV serotypes that may be used in the disclosed methods, include AAV1, AAV2, modified AAV2 (e.g., modifications at Y444F, Y500F, Y730F and/or S662V), AAV3, modified AAV3 (e.g., modifications at Y705F, Y731F and/or T492V), AAV4, AAV5, AAV6, modified AAV6 (e.g., modifications at S663V and/or T492V), AAV8, AAV 8.2, AAV9, AAV rh10, and pseudotyped AAV, such as AAV2/8, AAV2/5 and AAV2/6 can also be used in the disclosed methods.

In some embodiments, the Cas9- and/or gRNA-encoding DNA is delivered by a non-vector based method (e.g., using naked DNA or DNA complexes). For example, the DNA can be delivered, e.g., by organically modified silica or silicate (Ormosil), electroporation, gene gun, sonoporation, magnetofection, lipid-mediated transfection, dendrimers, inorganic nanoparticles, calcium phosphates, or a combination thereof.

In an embodiment, the delivery vehicle is a non-viral vector. In an embodiment, the non-viral vector is an inorganic nanoparticle. Exemplary inorganic nanoparticles include, e.g., magnetic nanoparticles (e.g., $Fe_3MnO_2$) and silica. The outer surface of the nanoparticle can be conjugated with a positively charged polymer (e.g., polyethylenimine, polylysine, polyserine) which allows for attachment (e.g., conjugation or entrapment) of payload. In an embodiment, the non-viral vector is an organic nanoparticle (e.g., entrapment of the payload inside the nanoparticle). Exemplary organic nanoparticles include, e.g., SNALP liposomes that contain cationic lipids together with neutral helper lipids which are coated with polyethylene glycol (PEG) and protamine and nucleic acid complex coated with lipid coating.

Exemplary lipids for gene transfer are shown below in Table IX.4.

TABLE IX.4

Lipids Used for Gene Transfer

| Lipid | Abbreviation | Feature |
|---|---|---|
| 1,2-Dioleoyl-sn-glycero-3-phosphatidylcholine | DOPC | Helper |
| 1,2-Dioleoyl-sn-glycero-3-phosphatidylethanolamine | DOPE | Helper |
| Cholesterol | | Helper |

TABLE IX.4-continued

Lipids Used for Gene Transfer

| Lipid | Abbreviation | Feature |
|---|---|---|
| N-[1-(2,3-Dioleyloxy)prophyl]N,N,N-trimethylammonium chloride | DOTMA | Cationic |
| 1,2-Dioleoyloxy-3-trimethylammonium-propane | DOTAP | Cationic |
| Dioctadecylamidoglycylspermine | DOGS | Cationic |
| N-(3-Aminopropyl)-N,N-dimethyl-2,3-bis(dodecyloxy)-1-propanaminium bromide | GAP-DLRIE | Cationic |
| Cetyltrimethylammonium bromide | CTAB | Cationic |
| 6-Lauroxyhexyl ornithinate | LHON | Cationic |
| 1-(2,3-Dioleoyloxypropyl)-2,4,6-trimethylpyridinium | 2Oc | Cationic |
| 2,3-Diolcyloxy-N-[2(sperminecarboxamido-ethyl]-N,N-dimethyl-1-propanaminium trifluoroacetate | DOSPA | Cationic |
| 1,2-Dioleyl-3-trimethylammonium-propane | DOPA | Cationic |
| N-(2-Hydroxyethyl)-N,N-dimethyl-2,3-bis(tetradecyloxy)-1-propanaminium bromide | MDRIE | Cationic |
| Dimyristooxypropyl dimethyl hydroxyethyl ammonium bromide | DMRI | Cationic |
| 3β-[N-(N',N'-Dimethylaminoethane)-carbamoyl]cholesterol | DC-Chol | Cationic |
| Bis-guanidium-tren-cholesterol | BGTC | Cationic |
| 1,3-Diodeoxy-2-(6-carboxy-spermyl)-propylamide | DOSPER | Cationic |
| Dimethyloctadecylammonium bromide | DDAB | Cationic |
| Dioctadecylamidoglycylspermidin | DSL | Cationic |
| rac-[(2,3-Dioctadecyloxypropyl)(2-hydroxyethyl)]-dimethylammonium chloride | CLIP-1 | Cationic |
| rac-[2(2,3-Dihexadecyloxypropyl-oxymethyloxy)ethyl]trimethylammonium bromide | CLIP-6 | Cationic |
| Ethyldimyristoylphosphatidylcholine | EDMPC | Cationic |
| 1,2-Distcaryloxy-N,N-dimethyl-3-aminopropane | DSDMA | Cationic |
| 1,2-Dimyristoyl-trimethylammonium propane | DMTAP | Cationic |
| O,O'-Dimyristyl-N-lysyl aspartate | DMKE | Cationic |
| 1,2-Distearoyl-sn-glycero-3-ethylphosphocholine | DSEPC | Cationic |
| N-Palmitoyl D-erythro-sphingosyl carbamoyl-spermine | CCS | Cationic |
| N-t-Butyl-N0-tetradecyl-3-tetradecylaminopropionamidine | diC14-amidine | Cationic |
| Octadecenolyoxy[ethyl-2-heptadecenyl-3 hydroxyethyl] imidazolinium chloride | DOTIM | Cationic |
| N1-Cholesteryloxycarbonyl-3,7-diazanonane-1,9-diamine | CDAN | Cationic |
| 2-(3-[Bis(3-amino-propyl)-amino]propylamino)-N-ditetradecylcarbamoylme-ethyl-acetamide | RPR209120 | Cationic |
| 1,2-dilinoleyloxy-3-dimethylaminopropane | DLinDMA | Cationic |
| 2,2-dilinoleyl-4-dimethylaminoethyl-[1,3]-dioxolane | DLin-KC2-DMA | Cationic |
| dilinoleyl-methyl-4-dimethylaminobutyrate | DLin-MC3-DMA | Cationic |

Exemplary polymers for gene transfer are shown below in Table IX.5.

TABLE IX.5

Polymers Used for Gene Transfer

| Polymer | Abbreviation |
|---|---|
| Poly(ethylene)glycol | PEG |
| Polyethylenimine | PEI |
| Dithiobis(succinimidylpropionate) | DSP |
| Dimethyl-3,3'-dithiobispropionimidate | DTBP |
| Poly(ethylene imine)biscarbamate | PEIC |
| Poly(L-lysine) | PLL |
| Histidine modified PLL | |
| Poly(N-vinylpyrrolidone) | PVP |
| Poly(propylenimine) | PPI |
| Poly(amidoamine) | PAMAM |
| Poly(amidoethylenimine) | SS-PAEI |
| Triethylenetetramine | TETA |
| Poly(β-aminoester) | |
| Poly(4-hydroxy-L-proline ester) | PHP |
| Poly(allylamine) | |
| Poly(α-[4-aminobutyl]-L-glycolic acid) | PAGA |
| Poly(D,L-lactic-co-glycolic acid) | PLGA |
| Poly(N-ethyl-4-vinylpyridinium bromide) | |
| Poly(phosphazene)s | PPZ |
| Poly(phosphoester)s | PPE |
| Poly(phosphoramidate)s | PPA |
| Poly(N-2-hydroxypropylmethacrylamide) | pHPMA |
| Poly (2-(dimethylamino)ethyl methacrylate) | pDMAEMA |
| Poly(2-aminoethyl propylene phosphate) | PPE-EA |
| Chitosan | |
| Galactosylated chitosan | |
| N-Dodacylated chitosan | |
| Histone | |
| Collagen | |
| Dextran-spermine | D-SPM |

In an embodiment, the vehicle has targeting modifications to increase target cell update of nanoparticles and liposomes, e.g., cell specific antigens, monoclonal antibodies, single chain antibodies, aptamers, polymers, sugars, and cell penetrating peptides. In an embodiment, the vehicle uses fusogenic and endosome-destabilizing peptides/polymers. In an embodiment, the vehicle undergoes acid-triggered conformational changes (e.g., to accelerate endosomal escape of the cargo). In an embodiment, a stimuli-cleavable polymer is used, e.g., for release in a cellular compartment. For example, disulfide-based cationic polymers that are cleaved in the reducing cellular environment can be used.

In an embodiment, the delivery vehicle is a biological non-viral delivery vehicle.

In an embodiment, one or more nucleic acid molecules (e.g., a DNA molecule or a template nucleic acid) other than the components of a Cas system, e.g., the Cas9 molecule component and/or the gRNA molecule component described herein, are delivered. In an embodiment, the nucleic acid molecule is delivered at the same time as one or more of the components of the Cas system are delivered. In an embodiment, the nucleic acid molecule is delivered before or after (e.g., less than about 30 minutes, 1 hour, 2 hours, 3 hours, 6 hours, 9 hours, 12 hours, 1 day, 2 days, 3 days, 1 week, 2 weeks, or 4 weeks) one or more of the components of the Cas system are delivered. In an embodiment, the nucleic acid molecule is delivered by a different means than one or more of the components of the Cas system, e.g., the Cas9 molecule component and/or the gRNA molecule component, are delivered. The nucleic acid molecule can be delivered by any of the delivery methods described herein. For example, the nucleic acid molecule can be delivered by a viral vector, e.g., an integration-deficient lentivirus, and the Cas9 molecule component and/or the gRNA molecule component can be delivered by electroporation, e.g., such that the toxicity caused by nucleic acids (e.g., DNAs) can be reduced. In an embodiment, the nucleic acid molecule encodes a therapeutic protein, e.g., a protein described herein. In an embodiment, the nucleic acid molecule encodes an RNA molecule, e.g., an RNA molecule described herein. In some embodiments, the nucleic acid is a template nucleic acid capable of participating in HDR.

Delivery of RNA Encoding a Cas9 Molecule

RNA encoding Cas9 molecules (e.g., eaCas9 molecules) and/or gRNA molecules, can be delivered into cells, e.g., target cells described herein, by any appropriate method, including art-known methods or methods described herein.

For example, Cas9-encoding and/or gRNA-encoding RNA can be delivered, e.g., by microinjection, electroporation, lipid-mediated transfection, peptide-mediated delivery, or a combination thereof.

Delivery of Cas9 Molecule Protein

Cas9 molecules (e.g., eaCas9 molecules) can be delivered into cells by any appropriate method, including art-known methods or methods described herein. For example, Cas9 protein molecules can be delivered, e.g., by microinjection, electroporation, lipid-mediated transfection, peptide-mediated delivery, or a combination thereof. Delivery can be accompanied by DNA encoding a gRNA or by a gRNA.

Route of Administration

Systemic modes of administration include oral and parenteral routes. Parenteral routes include, by way of example, intravenous, intrarterial, intraosseous, intramuscular, intradermal, subcutaneous, intranasal and intraperitoneal routes. Components administered systemically may be modified or formulated to target the components to the desired cell type.

Local modes of administration include, by way of example, intrathecal, intracerebroventricular, intraparenchymal (e.g., localized intraparenchymal delivery to the striatum (e.g., into the caudate or into the putamen)), cerebral cortex, precentral gyms, hippocampus (e.g., into the dentate gyrus or CA3 region), temporal cortex, amygdala, frontal cortex, thalamus, cerebellum, medulla, hypothalamus, tectum, tegmentum or substantia nigra intraocular, intraorbital, subconjctival, intravitreal, subretinal or transscleral routes. In an embodiment, significantly smaller amounts of the components (compared with systemic approaches) may exert an effect when administered locally (for example, intraparenchymal or intravitreal) compared to when administered systemically (for example, intravenously). Local modes of administration can reduce or eliminate the incidence of potentially toxic side effects that may occur when therapeutically effective amounts of a component are administered systemically.

Administration may be provided as a periodic bolus or as continuous infusion from an internal reservoir or from an external reservoir (for example, from an intravenous bag). Components may be administered locally, for example, by continuous release from a sustained release drug delivery device.

In some embodiments, the methods herein involve delivering macromolecules (e.g., a Cas9 protein or nucleic acid, a gRNA or nucleic acid encoding a gRNA, or a template nucleic acid, or any combination thereof) and small molecules (e.g., an HDR-enhancer). In some embodiments, the small molecule is delivered via a different route from one or more macromolecules. The small molecule may be administered, for instance, in a form suitable for oral, parenteral (including subcutaneous, intradermal, intramuscular, intravenous, and intraarticular), inhalation (including fine particle dusts or mists which may be generated by means of various types of metered doses, pressurized aerosols, nebulizers or insufflators, and including intranasally or via the lungs), rectal and topical (including dermal, transdermal, transmucosal, buccal, sublingual, and intraocular) administration, although the most suitable route may depend upon, for example, the condition and disorder of the recipient.

Bi-Modal or Differential Delivery of Components

Separate delivery of the components of a Cas system, e.g., the Cas9 molecule component and the gRNA molecule component, and more particularly, delivery of the components by differing modes, can enhance performance, e.g., by improving tissue specificity and safety.

In an embodiment, the Cas9 molecule and the gRNA molecule are delivered by different modes, or as sometimes referred to herein as differential modes. Different or differential modes, as used herein, refer to modes of delivery that confer different pharmacodynamic or pharmacokinetic properties on the subject component molecule, e.g., a Cas9 molecule, gRNA molecule, or template nucleic acid. For example, the modes of delivery can result in different tissue distribution, different half-life, or different temporal distribution, e.g., in a selected compartment, tissue, or organ. In many embodiments, the components are delivered so that Cas9 and the gRNA will be present in the same cell at the same time. In some embodiments, the HDR-enhancer molecule is delivered in a manner that allows HDR to be the favored repair pathway at the time the Cas9 molecule and gRNA cleave the desired region of the genome.

In some embodiments, two gRNAs are delivered to a cell so that a first nickase will make a first single strand break and a second nickase will make a second single strand break. In such embodiments, the two gRNAs and other components (e.g., the Cas9 molecule) are delivered such that the two breaks are made at substantially the same time. In some embodiments this comprises the second break being formed before the first break engages with machinery specific to the SSBR (single strand break repair) pathway, and in some embodiments, it comprises the second break being formed before the first break is repaired. More generally, when one desires to make two or more breaks in a target nucleic acid, the gRNAs and other components can be delivered such that the two or more breaks are made at substantially the same time.

Some modes of delivery, e.g., delivery by a nucleic acid vector that persists in a cell, or in progeny of a cell, e.g., by autonomous replication or insertion into cellular nucleic acid, result in more persistent expression of and presence of a component. Examples include viral, e.g., adeno-associated virus or lentivirus, delivery.

By way of example, the components, e.g., a Cas9 molecule and a gRNA molecule, can be delivered by modes that differ in terms of resulting half-life or persistent of the delivered component the body, or in a particular compartment, tissue or organ. In an embodiment, a gRNA molecule can be delivered by such modes. The Cas9 molecule component can be delivered by a mode which results in less persistence or less exposure to the body or a particular compartment or tissue or organ.

More generally, in an embodiment, a first mode of delivery is used to deliver a first component and a second mode of delivery is used to deliver a second component. The first mode of delivery confers a first pharmacodynamic or pharmacokinetic property. The first pharmacodynamic property can be, e.g., distribution, persistence, or exposure, of the component, or of a nucleic acid that encodes the component, in the body, a compartment, tissue or organ. The second mode of delivery confers a second pharmacodynamic or pharmacokinetic property. The second pharmacodynamic property can be, e.g., distribution, persistence, or exposure, of the component, or of a nucleic acid that encodes the component, in the body, a compartment, tissue or organ.

In an embodiment, the first pharmacodynamic or pharmacokinetic property, e.g., distribution, persistence or exposure, is more limited than the second pharmacodynamic or pharmacokinetic property.

In an embodiment, the first mode of delivery is selected to optimize, e.g., minimize, a pharmacodynamic or pharmacokinetic property, e.g., distribution, persistence or exposure.

In an embodiment, the second mode of delivery is selected to optimize, e.g., maximize, a pharmacodynamic or pharmacokinetic property, e.g., distribution, persistence or exposure.

In an embodiment, the first mode of delivery comprises the use of a relatively persistent element, e.g., a nucleic acid, e.g., a plasmid or viral vector, e.g., an AAV or lentivirus. As such vectors are relatively persistent product transcribed from them would be relatively persistent.

In an embodiment, the second mode of delivery comprises a relatively transient element, e.g., an RNA or protein.

In an embodiment, the first component comprises gRNA, and the delivery mode is relatively persistent, e.g., the gRNA is transcribed from a plasmid or viral vector, e.g., an AAV or lentivirus. Transcription of these genes would be of little physiological consequence because the genes generally do not encode for a protein product, and the gRNAs are incapable of acting in isolation. The second component, a Cas9 molecule, is delivered in a transient manner, for example as mRNA or as protein, ensuring that the full Cas9 molecule/gRNA molecule complex is only present and active for a short period of time.

Furthermore, the components can be delivered in different molecular form or with different delivery vectors that complement one another to enhance safety and tissue specificity.

Use of differential delivery modes can enhance performance, safety and efficacy. For example, the likelihood of an eventual off-target modification can be reduced. Delivery of immunogenic components, e.g., Cas9 molecules, by less persistent modes can reduce immunogenicity, as peptides from the bacterially-derived Cas enzyme are displayed on the surface of the cell by MHC molecules. A two-part delivery system can alleviate these drawbacks.

Differential delivery modes can be used to deliver components to different, but overlapping target regions. The formation active complex is minimized outside the overlap of the target regions. Thus, in an embodiment, a first component, e.g., a gRNA molecule is delivered by a first delivery mode that results in a first spatial, e.g., tissue, distribution. A second component, e.g., a Cas9 molecule is delivered by a second delivery mode that results in a second spatial, e.g., tissue, distribution. In an embodiment, the first mode comprises a first element selected from a liposome, nanoparticle, e.g., polymeric nanoparticle, and a nucleic acid, e.g., viral vector. The second mode comprises a second element selected from the group. In an embodiment, the first mode of delivery comprises a first targeting element, e.g., a cell specific receptor or an antibody, and the second mode of delivery does not include that element. In embodiment, the second mode of delivery comprises a second targeting element, e.g., a second cell specific receptor or second antibody.

When the Cas9 molecule is delivered in a virus delivery vector, a liposome, or polymeric nanoparticle, there is the potential for delivery to and therapeutic activity in multiple tissues, when it may be desirable to only target a single tissue. A two-part delivery system can resolve this challenge and enhance tissue specificity. If the gRNA molecule and the Cas9 molecule are packaged in separated delivery vehicles with distinct but overlapping tissue tropism, the fully functional complex is only formed in the tissue that is targeted by both vectors.

Ex Vivo Delivery

In some embodiments, components described in Table IX.1 or IX.2 and a HDR-enhancer are introduced into cells which are then introduced into the subject. Methods of introducing the components can include, e.g., any of the delivery methods described in Table IX.3.

In some embodiments, treating cells with an HDR-enhancer ex vivo reduces the risk of that HDR-enhancer causing a side effect that would likely occur if the HDR-enhancer was administered to the patient's body.

In some embodiments, the cells are contacted with a Cas9 molecule (or a nucleic acid encoding it) ex vivo. In some embodiments, the cells are contacted with a gRNA (or a nucleic acid encoding it) ex vivo. In some embodiment, the cells are contacted with a template nucleic acid ex vivo. In some embodiments, the cells are contacted with an HDR-enhancer (or a nucleic acid encoding it) ex vivo. In some embodiments, the cells are contacted with two, three, or all four of the preceding compositions (or nucleic acids encoding them) ex vivo. In some embodiments, the cells are contacted with one or more of the preceding components (or nucleic acids encoding them), and one or more remaining components are administered to the patient.

X. Modified Nucleosides, Nucleotides, and Nucleic Acids

Modified nucleosides and modified nucleotides can be present in nucleic acids, e.g., particularly gRNA and/or a template nucleic acid, but also other forms of DNA or RNA, e.g., mRNA, RNAi, or siRNA. As described herein, "nucleoside" is defined as a compound containing a five-carbon sugar molecule (a pentose such as deoxyribose or ribose) or derivative thereof, and an organic base (purine or pyrimidine, or a derivative thereof). As described herein, "nucleotide" is defined as a nucleoside further comprising a phosphate group.

Modified nucleosides and nucleotides can include one or more of:

(i) alteration, e.g., replacement, of one or both of the non-linking phosphate oxygens and/or of one or more of the linking phosphate oxygens in the phosphodiester backbone linkage;

(ii) alteration, e.g., replacement, of a constituent of the ribose or deoxyribose sugar, e.g., of the 2' hydroxyl on the sugar;

(iii) wholesale replacement of the phosphate moiety with "dephospho" linkers; (iv) modification or replacement of a naturally occurring nucleobase;

(v) replacement or modification of the ribose- or deoxyribose-phosphate backbone;

(vi) modification of the 3' end or 5' end of the oligonucleotide, e.g., removal, modification or replacement of a terminal phosphate group or conjugation of a moiety; and (vii) modification of the sugar.

The modifications listed above can be combined to provide modified nucleosides and nucleotides that can have two, three, four, or more modifications. For example, a modified nucleoside or nucleotide can have a modified sugar and a modified nucleobase. In an embodiment, every base of a gRNA or template nucleic acid is modified, e.g., all bases have a modified phosphate group, e.g., all are phosphorothioate groups. In an embodiment, all, or substantially all, of the phosphate groups of a unimolecular or modular gRNA molecule or template nucleic acid are replaced with phosphorothioate groups.

In an embodiment, modified nucleotides, e.g., nucleotides having modifications as described herein, can be incorporated into a nucleic acid, e.g., a "modified nucleic acid." In some embodiments, the modified nucleic acids comprise one, two, three or more modified nucleotides. In some embodiments, at least 5% (e.g., at least about 5%, at least about 10%, at least about 15%, at least about 20%, at least about 25%, at least about 30%, at least about 35%, at least about 40%, at least about 45%, at least about 50%, at least about 55%, at least about 60%, at least about 65%, at least about 70%, at least about 75%, at least about 80%, at least about 85%, at least about 90%, at least about 95%, or about 100%) of the positions in a modified nucleic acid are a modified nucleotides.

Unmodified nucleic acids can be prone to degradation by, e.g., cellular nucleases. For example, nucleases can hydrolyze nucleic acid phosphodiester bonds. Accordingly, in one aspect the modified nucleic acids described herein can contain one or more modified nucleosides or nucleotides, e.g., to introduce stability toward nucleases.

In some embodiments, the modified nucleosides, modified nucleotides, and modified nucleic acids described herein can exhibit a reduced innate immune response when introduced into a population of cells, both in vivo and ex vivo. The term "innate immune response" includes a cellular response to exogenous nucleic acids, including single stranded nucleic acids, generally of viral or bacterial origin, which involves the induction of cytokine expression and release, particularly the interferons, and cell death. In some embodiments, the modified nucleosides, modified nucleotides, and modified nucleic acids described herein can disrupt binding of a major groove interacting partner with the nucleic acid. In some embodiments, the modified nucleosides, modified nucleotides, and modified nucleic acids described herein can exhibit a reduced innate immune response when introduced into a population of cells, both in vivo and ex vivo, and also disrupt binding of a major groove interacting partner with the nucleic acid.

In some embodiments, a template nucleic acid comprises modifications, e.g., modified nucleotides, modifications to the backbone, and other modifications described herein. In some embodiments, the modification improves the stability of the template nucleic acid, e.g., by increasing its resistance to endonucleases and/or exonucleases.

In some embodiments, a template nucleic acid that comprises modifications is double stranded, e.g., is double stranded DNA. In some such embodiments, all the modifications are confined to one strand. In other embodiments, modifications are present on both strands. Modifications may be present in the 5' homology arm, the 3' homology arm, or the replacement sequence, or any combination thereof. In some embodiments, modifications are present in one or both homology arms but not the replacement sequence.

In some embodiments, a template nucleic acid that comprises modifications is single stranded, e.g., is single stranded DNA.

Definitions of Chemical Groups

As used herein, "alkyl" is meant to refer to a saturated hydrocarbon group which is straight-chained or branched. Example alkyl groups include methyl (Me), ethyl (Et), propyl (e.g., n-propyl and isopropyl), butyl (e.g., n-butyl, isobutyl, t-butyl), pentyl (e.g., n-pentyl, isopentyl, neopentyl), and the like. An alkyl group can contain from 1 to about 20, from 2 to about 20, from 1 to about 12, from 1 to about 8, from 1 to about 6, from 1 to about 4, or from 1 to about 3 carbon atoms.

As used herein, "aryl" refers to monocyclic or polycyclic (e.g., having 2, 3 or 4 fused rings) aromatic hydrocarbons such as, for example, phenyl, naphthyl, anthracenyl, phenanthrenyl, indanyl, indenyl, and the like. In some embodiments, aryl groups have from 6 to about 20 carbon atoms.

As used herein, "alkenyl" refers to an aliphatic group containing at least one double bond.

As used herein, "alkynyl" refers to a straight or branched hydrocarbon chain containing 2-12 carbon atoms and characterized in having one or more triple bonds. Examples of alkynyl groups include, but are not limited to, ethynyl, propargyl, and 3-hexynyl.

As used herein, "arylalkyl" or "aralkyl" refers to an alkyl moiety in which an alkyl hydrogen atom is replaced by an aryl group. Aralkyl includes groups in which more than one hydrogen atom has been replaced by an aryl group. Examples of "arylalkyl" or "aralkyl" include benzyl, 2-phenylethyl, 3-phenylpropyl, 9-fluorenyl, benzhydryl, and trityl groups.

As used herein, "cycloalkyl" refers to a cyclic, bicyclic, tricyclic, or polycyclic non-aromatic hydrocarbon groups having 3 to 12 carbons. Examples of cycloalkyl moieties include, but are not limited to, cyclopropyl, cyclopentyl, and cyclohexyl.

As used herein, "heterocyclyl" refers to a monovalent radical of a heterocyclic ring system. Representative heterocyclyls include, without limitation, tetrahydrofuranyl, tetrahydrothienyl, pyrrolidinyl, pyrrolidonyl, piperidinyl, pyrrolinyl, piperazinyl, dioxanyl, dioxolanyl, diazepinyl, oxazepinyl, thiazepinyl, and morpholinyl.

As used herein, "heteroaryl" refers to a monovalent radical of a heteroaromatic ring system. Examples of heteroaryl moieties include, but are not limited to, imidazolyl, oxazolyl, thiazolyl, triazolyl, pyrrolyl, furanyl, indolyl, thiophenyl pyrazolyl, pyridinyl, pyrazinyl, pyridazinyl, pyrimidinyl, indolizinyl, purinyl, naphthyridinyl, quinolyl, and pteridinyl.

Phosphate Backbone Modifications

The Phosphate Group

In some embodiments, the phosphate group of a modified nucleotide can be modified by replacing one or more of the oxygens with a different substituent. Further, the modified nucleotide, e.g., modified nucleotide present in a modified nucleic acid, can include the wholesale replacement of an unmodified phosphate moiety with a modified phosphate as described herein. In some embodiments, the modification of the phosphate backbone can include alterations that result in either an uncharged linker or a charged linker with unsymmetrical charge distribution.

Examples of modified phosphate groups include phosphorothioate, phosphoroselenates, borano phosphates, borano phosphate esters, hydrogen phosphonates, phosphoroamidates, alkyl or aryl phosphonates and phosphotriesters. In some embodiments, one of the non-bridging phosphate oxygen atoms in the phosphate backbone moiety can be replaced by any of the following groups: sulfur (S), selenium (Se), $BR_3$ (wherein R can be, e.g., hydrogen, alkyl, or aryl), C (e.g., an alkyl group, an aryl group, and the like), H, $NR_2$ (wherein R can be, e.g., hydrogen, alkyl, or aryl), or OR (wherein R can be, e.g., alkyl or aryl). The phosphorous atom in an unmodified phosphate group is achiral. However, replacement of one of the non-bridging oxygens with one of the above atoms or groups of atoms can render the phosphorous atom chiral; that is to say that a phosphorous atom in a phosphate group modified in this way is a stereogenic center. The stereogenic phosphorous atom can possess either the "R" configuration (herein Rp) or the "S" configuration (herein Sp).

Phosphorodithioates have both non-bridging oxygens replaced by sulfur. The phosphorus center in the phosphorodithioates is achiral which precludes the formation of oligoribonucleotide (or oligodeoxyribonucleotide) diastereomers. In some embodiments, modifications to one or both non-bridging oxygens can also include the replacement of the non-bridging oxygens with a group independently selected from S, Se, B, C, H, N, and OR (R can be, e.g., alkyl or aryl).

The phosphate linker can also be modified by replacement of a bridging oxygen, (i.e., the oxygen that links the phosphate to the nucleoside), with nitrogen (bridged phosphoroamidates), sulfur (bridged phosphorothioates) and carbon (bridged methylenephosphonates). The replacement can occur at either linking oxygen or at both of the linking oxygens.

Replacement of the Phosphate Group

The phosphate group can be replaced by non-phosphorus containing connectors. In some embodiments, the charge phosphate group can be replaced by a neutral moiety.

Examples of moieties which can replace the phosphate group can include, without limitation, e.g., methyl phosphonate, hydroxylamino, siloxane, carbonate, carboxymethyl, carbamate, amide, thioether, ethylene oxide linker, sulfonate, sulfonamide, thioformacetal, formacetal, oxime, methyleneimino, methylenemethylimino, methylenehydrazo, methylenedimethylhydrazo and methyleneoxymethylimino.

Replacement of the Ribophosphate Backbone

Scaffolds that can mimic nucleic acids can also be constructed wherein the phosphate linker and ribose sugar are replaced by nuclease resistant nucleoside or nucleotide surrogates. In some embodiments, the nucleobases can be tethered by a surrogate backbone. Examples can include, without limitation, the morpholino, cyclobutyl, pyrrolidine and peptide nucleic acid (PNA) nucleoside surrogates.

Sugar Modifications

The modified nucleosides and modified nucleotides can include one or more modifications to the sugar group. For example, the 2' hydroxyl group (OH) can be modified or replaced with a number of different "oxy" or "deoxy" substituents. In some embodiments, modifications to the 2' hydroxyl group can enhance the stability of the nucleic acid since the hydroxyl can no longer be deprotonated to form a 2'-alkoxide ion. The 2'-alkoxide can catalyze degradation by intramolecular nucleophilic attack on the linker phosphorus atom.

Examples of "oxy"-2' hydroxyl group modifications can include alkoxy or aryloxy (OR, wherein "R" can be, e.g., alkyl, cycloalkyl, aryl, aralkyl, heteroaryl or a sugar); polyethyleneglycols (PEG), $O(CH_2CH_2O)_nCH_2CH_2OR$ wherein R can be, e.g., H or optionally substituted alkyl, and n can be an integer from 0 to 20 (e.g., from 0 to 4, from 0 to 8, from 0 to 10, from 0 to 16, from 1 to 4, from 1 to 8, from 1 to 10, from 1 to 16, from 1 to 20, from 2 to 4, from 2 to 8, from 2 to 10, from 2 to 16, from 2 to 20, from 4 to 8, from 4 to 10, from 4 to 16, and from 4 to 20). In some embodiments, the "oxy"-2' hydroxyl group modification can include "locked" nucleic acids (LNA) in which the 2' hydroxyl can be connected, e.g., by a $C_{1-6}$ alkylene or $C_{1-6}$ heteroalkylene bridge, to the 4' carbon of the same ribose sugar, where exemplary bridges can include methylene, propylene, ether, or amino bridges; O-amino (wherein amino can be, e.g., $NH_2$; alkylamino, dialkylamino, heterocyclyl, arylamino, diarylamino, heteroarylamino, or diheteroarylamino, ethylenediamine, or polyamino) and aminoalkoxy, $O(CH_2)_n$-amino, (wherein amino can be, e.g., $NH_2$; alkylamino, dialkylamino, heterocyclyl, arylamino, diarylamino, heteroarylamino, or diheteroarylamino, ethylenediamine, or polyamino). In some embodiments, the "oxy"-2' hydroxyl group modification can include the methoxyethyl group (MOE), ($OCH_2CH_2OCH_3$, e.g., a PEG derivative).

"Deoxy" modifications can include hydrogen (i.e. deoxyribose sugars, e.g., at the overhang portions of partially ds RNA); halo (e.g., bromo, chloro, fluoro, or iodo); amino (wherein amino can be, e.g., $NH_2$; alkylamino, dialkylamino, heterocyclyl, arylamino, diarylamino, heteroarylamino, diheteroarylamino, or amino acid); $NH(CH_2CH_2NH)_nCH_2CH_2$-amino (wherein amino can be, e.g., as described herein), —NHC(O)R (wherein R can be, e.g., alkyl, cycloalkyl, aryl, aralkyl, heteroaryl or sugar), cyano; mercapto; alkyl-thio-alkyl; thioalkoxy; and alkyl, cycloalkyl, aryl, alkenyl and alkynyl, which may be optionally substituted with, e.g., an amino as described herein.

The sugar group can also contain one or more carbons that possess the opposite stereochemical configuration than that of the corresponding carbon in ribose. Thus, a modified nucleic acid can include nucleotides containing e.g., arabinose, as the sugar. The nucleotide "monomer" can have an alpha linkage at the 1' position on the sugar, e.g., alpha-nucleosides. The modified nucleic acids can also include "abasic" sugars, which lack a nucleobase at C-1'. These abasic sugars can also be further modified at one or more of the constituent sugar atoms. The modified nucleic acids can also include one or more sugars that are in the L form, e.g., L-nucleosides.

Generally, RNA includes the sugar group ribose, and DNA includes the sugar group deoxyribose, each of which is a 5-membered ring having an oxygen. Exemplary modified nucleosides and modified nucleotides can include, without limitation, replacement of the oxygen in the ribose or deoxyribose ring (e.g., with sulfur (S), selenium (Se), or alkylene, such as, e.g., methylene or ethylene); addition of a double bond (e.g., to replace ribose with cyclopentenyl or cyclohexenyl); ring contraction of ribose (e.g., to form a 4-membered ring of cyclobutane or oxetane); ring expansion of ribose (e.g., to form a 6- or 7-membered ring having an additional carbon or heteroatom, such as for example, anhydrohexitol, altritol, mannitol, cyclohexanyl, cyclohexenyl, and morpholino that also has a phosphoramidate backbone). In some embodiments, the modified nucleotides can include multicyclic forms (e.g., tricyclo; and "unlocked" forms, such as glycol nucleic acid (GNA) (e.g., R-GNA or S-GNA, where ribose is replaced by glycol units attached to phosphodiester bonds), threose nucleic acid (TNA, where ribose is replaced with α-L-threofuranosyl-(3'→2')).

Modifications on the Nucleobase

The modified nucleosides and modified nucleotides described herein, which can be incorporated into a modified nucleic acid, can include a modified nucleobase. Examples of nucleobases include, but are not limited to, adenine (A), guanine (G), cytosine (C), and uracil (U). These nucleobases can be modified or wholly replaced to provide modified nucleosides and modified nucleotides that can be incorporated into modified nucleic acids. The nucleobase of the nucleotide can be independently selected from a purine, a pyrimidine, a purine or pyrimidine analog. In some embodiments, the nucleobase can include, for example, naturally-occurring and synthetic derivatives of a base.

Uracil

In some embodiments, the modified nucleobase is a modified uracil. Exemplary nucleobases and nucleosides having a modified uracil include without limitation pseudouridine (ψ), pyridin-4-one ribonucleoside, 5-aza-uridine, 6-aza-uridine, 2-thio-5-aza-uridine, 2-thio-uridine (s2U), 4-thio-uridine (s4U), 4-thio-pseudouridine, 2-thio-pseudouridine, 5-hydroxy-uridine (ho$^5$U), 5-aminoallyl-uridine, 5-halo-uridine (e.g., 5-iodo-uridine or 5-bromo-uridine), 3-methyl-uridine (m$^3$U), 5-methoxy-uridine (mo$^5$U), uridine 5-oxyacetic acid (cmo⁵U), uridine 5-oxyacetic acid methyl ester (mcmo⁵U), 5-carboxymethyl-uridine (cm⁵U), 1-carboxymethyl-pseudouridine, 5-carboxyhydroxymethyl-uridine (chm⁵U), 5-carboxyhydroxymethyl-uridine methyl ester (mchm⁵U), 5-methoxycarbonylmethyl-uridine (mcm⁵U), 5-methoxycarbonylmethyl-2-thio-uridine (mcm⁵s2U), 5-aminomethyl-2-thio-uridine (nm⁵s2U), 5-methylaminomethyl-uridine (mnm⁵U), 5-methylaminomethyl-2-thio-uridine (mnm⁵s2U), 5-methylaminomethyl-2-seleno-uridine (mnm⁵se²U), 5-carbamoylmethyl-uridine (ncm⁵U), 5-carboxymethylaminomethyl-uridine (cmnm⁵U), 5-carboxymethylaminomethyl-2-thio-uridine (cmnm⁵s2U), 5-propynyl-uridine, 1-propynyl-pseudouridine, 5-taurinomethyl-uridine (τcm⁵U), 1-taurinomethyl-pseudouridine, 5-taurinomethyl-2-thio-uridine (τm⁵s2U), 1-taurinomethyl-4-thio-pseudouridine, 5-methyl-uridine (m⁵U, i.e., having the nucleobase deoxythymine), 1-methyl-pseudouridine (m¹ψ), 5-methyl-2-thio-uridine (m⁵s2U), 1-methyl-4-thio-pseudouridine (m¹s⁴ψ), 4-thio-1-methyl-pseudouridine, 3-methyl-pseudouridine (m³ψ), 2-thio-1-methyl-pseudouridine, 1-methyl-1-deaza-pseudouridine, 2-thio-1-methyl-1-deaza-pseudouridine, dihydrouridine (D), dihydropseudouridine, 5,6-dihydrouridine, 5-methyl-dihydrouridine (m⁵D), 2-thio-dihydrouridine, 2-thio-dihydropseudouridine, 2-methoxy-uridine, 2-methoxy-4-thio-uridine, 4-methoxy-pseudouridine, 4-methoxy-2-thio-pseudouridine, N1-methyl-pseudouridine, 3-(3-amino-3-carboxypropyl) uridine (acp³U), 1-methyl-3-(3-amino-3-carboxypropyl) pseudouridine (acp³ψ), 5-(isopentenylaminomethyl)uridine (inm⁵U), 5-(isopentenylaminomethyl)-2-thio-uridine (inm⁵s2U), α-thio-uridine, 2'-O-methyl-uridine (Um), 5,2'-O-dimethyl-uridine (m⁵Um), 2'-O-methyl-pseudouridine (ψm), 2-thio-2'-O-methyl-uridine (s2Um), 5-methoxycarbonylmethyl-2'-O-methyl-uridine (mcm⁵Um), 5-carbamoylmethyl-2'-O-methyl-uridine (ncm⁵Um), 5-carboxymethylaminomethyl-2'-O-methyl-uridine (cmnm⁵Um), 3,2'-O-dimethyl-uridine (m³Um), 5-(isopentenylaminomethyl)-2'-O-methyl-uridine (inm⁵Um), 1-thio-uridine, deoxythymidine, 2'-F-ara-uridine, 2'-F-uridine, 2'-OH-ara-uridine, 5-(2-carbomethoxyvinyl) uridine, 5-[3-(1-E-propenylamino)uridine, pyrazolo[3,4-d]pyrimidines, xanthine, and hypoxanthine.

Thymine

In some embodiments, the modified nucleobase is a modified thymine. Thymine differs from uracil in that thymine has a methyl group on carbon 5 of the 6-carbon ring, while uracil has a hydrogen in that position. In some embodiments, the modified thymine is derived from one of the modified uracils described in the previous paragraph, but having said methyl group instead of a hydrogen.

Cytosine

In some embodiments, the modified nucleobase is a modified cytosine. Exemplary nucleobases and nucleosides having a modified cytosine include without limitation 5-aza-cytidine, 6-aza-cytidine, pseudoisocytidine, 3-methyl-cytidine (m³C), N4-acetyl-cytidine (act), 5-formyl-cytidine (f⁵C), N4-methyl-cytidine (m⁴C), 5-methyl-cytidine (m⁵C), 5-halo-cytidine (e.g., 5-iodo-cytidine), 5-hydroxymethyl-cytidine (hm⁵C), 1-methyl-pseudoisocytidine, pyrrolo-cytidine, pyrrolo-pseudoisocytidine, 2-thio-cytidine (s2C), 2-thio-5-methyl-cytidine, 4-thio-pseudoisocytidine, 4-thio-1-methyl-pseudoisocytidine, 4-thio-1-methyl-1-deaza-pseudoisocytidine, 1-methyl-1-deaza-pseudoisocytidine, zebularine, 5-aza-zebularine, 5-methyl-zebularine, 5-aza-2-thio-zebularine, 2-thio-zebularine, 2-methoxy-cytidine, 2-methoxy-5-methyl-cytidine, 4-methoxy-pseudoisocytidine, 4-methoxy-1-methyl-pseudoisocytidine, lysidine (k²C), α-thio-cytidine, 2'-O-methyl-cytidine (Cm), 5,2'-O-dimethyl-cytidine (m⁵Cm), N4-acetyl-2'-O-methyl-cytidine (ac⁴Cm), N4,2'-O-dimethyl-cytidine (m⁴Cm), 5-formyl-2'-O-methyl-cytidine (f⁵Cm), N4,N4,2'-O-trimethyl-cytidine (m⁴₂Cm), 1-thio-cytidine, 2'-F-ara-cytidine, 2'-F-cytidine, and 2'-OH-ara-cytidine.

Adenine

In some embodiments, the modified nucleobase is a modified adenine. Exemplary nucleobases and nucleosides having a modified adenine include without limitation 2-amino-purine, 2,6-diaminopurine, 2-amino-6-halo-purine (e.g., 2-amino-6-chloro-purine), 6-halo-purine (e.g., 6-chloro-purine), 2-amino-6-methyl-purine, 8-azido-adenosine, 7-deaza-adenine, 7-deaza-8-aza-adenine, 7-deaza-2-amino-purine, 7-deaza-8-aza-2-amino-purine, 7-deaza-2,6-diaminopurine, 7-deaza-8-aza-2,6-diaminopurine, 1-methyl-adenosine (m¹A), 2-methyl-adenine (m²A), N6-methyl-adenosine (m⁶A), 2-methylthio-N6-methyl-adenosine (ms2 m⁶A), N6-isopentenyl-adenosine (i⁶A), 2-methylthio-N6-isopentenyl-adenosine (ms²i⁶A), N6-(cis-hydroxyisopentenyl)adenosine (io⁶A), 2-methylthio-N6-(cis-hydroxyisopentenyl)adenosine (ms2io⁶A), N6-glycinylcarbamoyl-adenosine (g⁶A), N6-threonylcarbamoyl-adenosine (t⁶A), N6-methyl-N6-threonylcarbamoyl-adenosine (m⁶t⁶A), 2-methylthio-N6-threonylcarbamoyl-adenosine (ms²g⁶A), N6,N6-dimethyl-adenosine (m⁶₂A), N6-hydroxynorvalylcarbamoyl-adenosine (hn⁶A), 2-methylthio-N6-hydroxynorvalylcarbamoyl-adenosine (ms2hn⁶A), N6-acetyl-adenosine (ac⁶A), 7-methyl-adenine, 2-methylthio-adenine, 2-methoxy-adenine, α-thio-adenosine, 2'-O-methyl-adenosine (Am), N⁶,2'-O-dimethyl-adenosine (m⁶Am), N⁶-Methyl-2'-deoxyadenosine, N6,N6,2'-O-trimethyl-adenosine (m⁶₂Am), 1,2'-O-dimethyl-adenosine (m¹Am), 2'-O-ribosyladenosine (phosphate) (Ar(p)), 2-amino-N6-methyl-purine, 1-thio-adenosine, 8-azido-adenosine, 2'-F-ara-adenosine, 2'-F-adenosine, 2'-OH-ara-adenosine, and N6-(19-amino-pentaoxanonadecyl)-adenosine.

Guanine

In some embodiments, the modified nucleobase is a modified guanine. Exemplary nucleobases and nucleosides having a modified guanine include without limitation inosine (I), 1-methyl-inosine (m¹I), wyosine (imG), methylwyosine (mimG), 4-demethyl-wyosine (imG-14), isowyosine (imG2), wybutosine (yW), peroxywybutosine (o₂yW), hydroxywybutosine (OHyW), undermodified hydroxywybutosine (OHyW*), 7-deaza-guanosine, queuosine (Q), epoxyqueuosine (oQ), galactosyl-queuosine (galQ), mannosyl-queuosine (manQ), 7-cyano-7-deaza-guanosine (preQ₀), 7-aminomethyl-7-deaza-guanosine (preQ₁), archaeosine (G⁺), 7-deaza-8-aza-guanosine, 6-thio-guanosine, 6-thio-7-deaza-guanosine, 6-thio-7-deaza-8-aza-guanosine, 7-methyl-guanosine (m⁷G), 6-thio-7-methyl-guanosine, 7-methyl-inosine, 6-methoxy-guanosine, 1-methyl-guanosine (m'G), N2-methyl-guanosine (m²G), N2,N2-dimethyl-guanosine (m²₂G), N2,7-dimethyl-guanosine (m²,7G), N2,N2,7-dimethyl-guanosine (m²,2,7G), 8-oxo-guanosine, 7-methyl-8-oxo-guanosine, 1-meth thio-guanosine, N2-methyl-6-thio-guanosine, N2,N2-dimethyl-6-thio-guanosine, α-thio-guanosine, 2'-O-methyl-guanosine (Gm), N2-methyl-2'-O-methyl-guanosine (m²Gm), N2,N2-dimethyl-2'-O-methyl-guanosine (m²₂Gm), 1-methyl-2'-O-methyl-guanosine (m'Gm), N2,7-dimethyl-2'-O-methyl-guanosine (m²,7Gm), 2'-O-methyl-inosine (Im), 1,2'-O-dimethyl-inosine (m'Im), O⁶-phenyl-2'-deoxyinosine, 2'-O-ribosylguanosine (phosphate) (Gr(p)), 1-thio-guanosine, $O^6$-methyl-guanosine, $O^6$-Methyl-2'-deoxyguanosine, 2'-F-ara-guanosine, and 2'-F-guanosine.

Modified gRNAs

In some embodiments, the modified nucleic acids can be modified gRNAs. In some embodiments, gRNAs can be modified at the 3' end. In this embodiment, the gRNAs can be modified at the 3' terminal U ribose. For example, the two terminal hydroxyl groups of the U ribose can be oxidized to aldehyde groups and a concomitant opening of the ribose ring to afford a modified nucleoside as shown below:

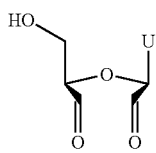

wherein "U" can be an unmodified or modified uridine.

In another embodiment, the 3' terminal U can be modified with a 2'3' cyclic phosphate as shown below:

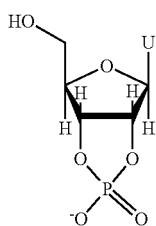

wherein "U" can be an unmodified or modified uridine.

In some embodiments, the gRNA molecules may contain 3' nucleotides which can be stabilized against degradation, e.g., by incorporating one or more of the modified nucleotides described herein. In this embodiment, e.g., uridines can be replaced with modified uridines, e.g., 5-(2-amino)propyl uridine, and 5-bromo uridine, or with any of the modified uridines described herein; adenosines and guanosines can be replaced with modified adenosines and guanosines, e.g., with modifications at the 8-position, e.g., 8-bromo guanosine, or with any of the modified adenosines or guanosines described herein. In some embodiments, deaza nucleotides, e.g., 7-deaza-adenosine, can be incorporated into the gRNA. In some embodiments, O- and N-alkylated nucleotides, e.g., N6-methyl andenosine, can be incorporated into the gRNA. In some embodiments, sugar-modified ribonucleotides can be incorporated, e.g., wherein the 2' OH-group is replaced by a group selected from H, —OR, —R (wherein R can be, e.g., alkyl, cycloalkyl, aryl, aralkyl, heteroaryl or sugar), halo, —SH, —SR (wherein R can be, e.g., alkyl, cycloalkyl, aryl, aralkyl, heteroaryl or sugar), amino (wherein amino can be, e.g., $NH_2$; alkylamino, dialkylamino, heterocyclyl, arylamino, diarylamino, heteroarylamino, diheteroarylamino, or amino acid); or cyano (—CN). In some embodiments, the phosphate backbone can be modified as described herein, e.g., with a phosphothioate group. In some embodiments, the nucleotides in the overhang region of the gRNA can each independently be a modified or unmodified nucleotide including, but not limited to 2'-sugar modified, such as, 2-F 2'-O-methyl, thymidine (T), 2'-O-methoxyethyl-5-methyluridine (Teo), 2'-O-methoxyethyladenosine (Aeo), 2'-O-methoxyethyl-5-methylcytidine (m5Ceo), and any combinations thereof.

In an embodiment, one or more or all of the nucleotides in single stranded RNA molecule, e.g., a gRNA molecule, are deoxynucleotides.

In another aspect, methods and compositions discussed herein provide methods and compositions for gene editing by using a gRNA molecule which comprises a polyA tail. In one embodiment, a polyA tail of undefined length ranging from 1 to 1000 nucleotide(s) is added enzymatically using a polymerase such as E. coli polyA polymerase (E-PAP). In one embodiment, the polyA tail of a specified length (e.g., 1, 5, 10, 20, 30, 40, 50, 60, 100, or 150 nucleotides) is encoded on a DNA template and transcribed with the gRNA via an RNA polymerase (e.g., T7 RNA polymerase). In one embodiment, a polyA tail of defined length (e.g., 1, 5, 10, 20, 30, 40, 50, 60, 100, or 150 nucleotides) is synthesized as a synthetic oligonucleotide and ligated on the 3' end of the gRNA with either an RNA ligase or a DNA ligase with our without a splinted DNA oligonucleotide complementary to the guide RNA and the polyA oligonucleotide. In one embodiment, the entire gRNA including a defined length of polyA tail is made synthetically, in one or several pieces, and, if made in more than one piece, ligated together by either an RNA ligase or a DNA ligase with or without a splinted oligonucleotide.

Modified Template Nucleic Acids

In some embodiments, the template nucleic acid comprises chemical modifications. These modifications may, e.g., increase the stability or half-life of the nucleic acid or reduce the innate immune response to the nucleic acid.

In some embodiments, the template nucleic acid can be modified at one or two 3' ends. In this embodiment, the template nucleic acid can be modified at the 3' nucleotide. For example, the two terminal hydroxyl groups of the 3'-most sugar can be oxidized to aldehyde groups and a concomitant opening of the ring to afford a modified nucleoside, analogous to the first ribonucleotide shown in the previous section entitled "Modified gRNAs".

In another embodiment, the 3' terminal sugar can be modified with a 2'3' cyclic phosphate, analogous to the second ribonucleotide shown in the previous section entitled "Modified gRNAs".

In some embodiments, the template nucleic acid may contain 3' nucleotides which can be stabilized against degradation, e.g., by incorporating one or more of the modified nucleotides described herein. In this embodiment, e.g., thymines can be replaced with any of the modified thymines described herein; adenosines and guanosines can be replaced with modified adenosines and guanosines, e.g., with modifications at the 8-position, e.g., 8-bromo guanosine, or with any of the modified adenosines or guanosines described herein. In some embodiments, deaza nucleotides, e.g., 7-deaza-adenosine, can be incorporated into the template nucleic acid. In some embodiments, O- and N-alkylated nucleotides, e.g., N6-methyl andenosine, can be incorporated into the template nucleic acid. In some embodiments, sugar-modified deoxyribonucleotides can be incorporated, e.g., wherein the 2' H-group is replaced by a group selected from OH, —OR, —R (wherein R can be, e.g., alkyl, cycloalkyl, aryl, aralkyl, heteroaryl or sugar), halo, —SH, —SR (wherein R can be, e.g., alkyl, cycloalkyl, aryl, aralkyl, heteroaryl or sugar), amino (wherein amino can be, e.g., $NH_2$; alkylamino, dialkylamino, heterocyclyl, arylamino, diarylamino, heteroarylamino, diheteroarylamino, or amino acid); or cyano (—CN). In some embodiments, the phosphate backbone can be modified as described herein, e.g., with a phosphothioate group. In some embodiments, the template nucleic acid comprises an overhang region, and the nucleotides in the overhang region can each independently be a modified or unmodified nucleotide including, but not limited to 2'-sugar modified, such as, 2-F 2'-O-methyl, 2'-O-methoxyethyl-5-methyluridine (Teo), 2'-O-methoxyethyladenosine (Aeo), 2'-O-methoxyethyl-5-methylcytidine (m5Ceo), and any combinations thereof.

In some embodiments, the template nucleic acid is nicked, e.g., at the same position as a nick or DSB on target nucleic acid. While not wishing to be bound by theory, in some embodiments, a nick on a double stranded template nucleic acid stimulates HDR. In some embodiments, one or more nicks on the template nucleic acid are on the strand that is complementary to the intact target strand; in embodiments, one or more nicks on the template nucleic acid are on the strand that is complementary to the nicked target stand.

miRNA Binding Sites

MicroRNAs (or miRNAs) are naturally occurring cellular 19-25 nucleotide long noncoding RNAs. They bind to nucleic acid molecules having an appropriate miRNA binding site, e.g., in the 3' UTR of an mRNA, and down-regulate gene expression. While not wishing to be bound by theory it is believed that the down regulation is either by reducing nucleic acid molecule stability or by inhibiting translation. An RNA species disclosed herein, e.g., an mRNA encoding Cas9 can comprise an miRNA binding site, e.g., in its 3'UTR. The miRNA binding site can be selected to promote down regulation of expression is a selected cell type. By way of example, the incorporation of a binding site for miR-122, a microRNA abundant in liver, can inhibit the expression of the gene of interest in the liver.

XI. Nucleic Acids; Kits; Methods of Production

In some aspects, disclosed herein is a nucleic acid, e.g., an isolated or non-naturally occurring nucleic acid, e.g., DNA, that comprises a sequence that encodes a gRNA molecule comprising a targeting domain that is complementary with a target domain as disclosed herein. In an embodiment, the nucleic acid encodes a gRNA molecule, e.g., a first gRNA molecule, comprising a targeting domain configured to provide a cleavage event, e.g., a double strand break or a single strand break, sufficiently close to a region desired to be altered to allow alteration, e.g., alteration associated with HDR of the region desired to be altered.

A nucleic acid disclosed herein may comprise (a) a sequence that encodes a gRNA molecule comprising a targeting domain that is complementary with a target domain as disclosed herein; (b) a sequence that encodes a Cas9 molecule; and further comprises (c) (i) a sequence that encodes a second gRNA molecule described herein having a targeting domain that is complementary to a second target domain, and optionally, (ii) a sequence that encodes a third gRNA molecule described herein having a targeting domain that is complementary to a third target domain; and optionally, (iii) a sequence that encodes a fourth gRNA molecule described herein having a targeting domain that is complementary to a fourth target domain.

In some embodiments, when a region that is desired to be altered is corrected by HDR (e.g., alt-HR, SSA, or HR), the nucleic acid encodes (a) a sequence that encodes a gRNA molecule comprising a targeting domain that is complementary with a target domain gene as disclosed herein; (b) a sequence that encodes a Cas9 molecule; (c) a template nucleic acid, (d) a HDR enhancer, and optionally, (e) (i) a sequence that encodes a second gRNA molecule described herein having a targeting domain that is complementary to a second target domain, and further optionally, (ii) a sequence that encodes a third gRNA molecule described herein having a targeting domain that is complementary to a third target domain; and still further optionally, (iii) a sequence that encodes a fourth gRNA molecule described herein having a targeting domain that is complementary to a fourth target domain.

As described above, a nucleic acid may comprise (a) a sequence encoding a gRNA molecule, and (b) a sequence encoding a Cas9 molecule. In some embodiments, (a) and (b) are present on the same nucleic acid molecule, e.g., the same vector, e.g., the same viral vector, e.g., the same adeno-associated virus (AAV) vector. In an embodiment, the nucleic acid molecule is an AAV vector. Exemplary AAV vectors that may be used in any of the described compositions and methods include an AAV2 vector, a modified AAV2 vector, an AAV3 vector, a modified AAV3 vector, an AAV6 vector, a modified AAV6 vector, an AAV8 vector and an AAV9 vector.

In other embodiments, (a) is present on a first nucleic acid molecule, e.g., a first vector, e.g., a first viral vector, e.g., a first AAV vector; and (b) is present on a second nucleic acid molecule, e.g., a second vector, e.g., a second vector, e.g., a second AAV vector. The first and second nucleic acid molecules may be AAV vectors.

In some embodiments, all of (a), (b), (c), (d), and optionally (e) are on the same vector, e.g., the same AAV vector. (It is understood that when the HDR enhancer (d) is on a nucleic acid or vector, it is implied that the HDR-enhancer molecule is capable of being encoded on a vector, e.g., the HDR-enhancer may be a protein, a ribozyme, a siRNA, an RNAi oligonucleotides, and the like.) In some embodiments, all of (a), (b), (c), (d), and optionally (e) are on different vectors, e.g., one or more AAV vectors. In some embodiments, two or more, e.g., two, three, or four of (a), (b), (c), (d), and optionally (e) are on the same vector, e.g., an AAV vector, and the remainder are on one or more other vectors, e.g., one or more AAV vectors. In some embodiments, (a) and (b) are on the same vector, e.g., an AAV vector; (a) and (c) are on the same vector, e.g., an AAV vector, (a) and (d) are on the same vector, e.g., an AAV vector, (b) and (c) are on the same vector, e.g., an AAV vector, (b) and (d) are on the same vector, e.g., an AAV vector, or (c) and (d) are on the same vector, e.g., an AAV vector.

The nucleic acids described herein may comprise a promoter operably linked to the sequence that encodes the gRNA molecule of (a), e.g., a promoter described herein. The nucleic acid may further comprise a second promoter operably linked to the sequence that encodes the second, third and/or fourth gRNA molecule of (e), e.g., a promoter described herein. The promoter and second promoter differ from one another. In some embodiments, the promoter and second promoter are the same.

The nucleic acids described herein may further comprise a promoter operably linked to the sequence that encodes the Cas9 molecule of (b), e.g., a promoter described herein.

The nucleic acids described herein may further comprise a promoter operably linked to the sequence that encodes the HDR-enhancer of (d), e.g., a promoter described herein.

In another aspect, disclosed herein is a kit comprising one or more, e.g., all of the following:

(a) gRNA molecule described herein, or nucleic acid that encodes the gRNA;

(b) a Cas9 molecule, e.g., a Cas9 molecule described herein, or a nucleic acid or mRNA that encodes the Cas9;

(c) a template nucleic acid; and (d) an HDR-enhancer.

In an embodiment, the kit comprises nucleic acid, e.g., an AAV vector, that encodes one or more of (a), (b), (c), and (d).

XII. Methods of Treatment

A genetic disease is caused by a mutation in the patient's genome. Often, the mutation results in a change in a protein, e.g., an amino acid substitution or a truncation. Genetic diseases can be dominant, i.e., one mutant gene is sufficient to cause the disease, or recessive, where a patient with one copy of the mutant gene is an asymptomatic carrier, and two copies of the mutant gene are necessary for the disease to result.

Disclosed herein are the approaches to treat or prevent genetic diseases, using the compositions and methods described herein.

One approach to treat or prevent genetic diseases is to repair (i.e., correct) one or more mutations in the disease-causing gene by HDR. In this approach, mutant allele(s) are corrected and restored to wild type state. While not wishing to be bound by theory, it is believed that correction of the mutation to the corresponding wild-type sequence restores wild type protein production within the relevant cell type. The method described herein can be performed in all cell types.

In an embodiment, one mutant allele is repaired in the subject. For example, in a patient with an autosomal dominant genetic disease, the sole mutant allele in the cell is corrected so that the cell becomes wild-type at both loci. As another example, in a patient with an autosomal recessive genetic disease, one of the two mutant alleles in the cell is corrected, and so the cell becomes heterozygous, which is sufficient for normal functioning. As a recessive genetic disease only displays a phenotype when both alleles are mutated, repair of a single allele is adequate for a cure. In another embodiment, both mutant alleles are repaired in the subject. In either situation, the subjects can be cured of disease.

Correction of a mutation in the relevant gene may be performed prior to disease onset (e.g., prior to the appearance of symptoms) or after disease onset, for instance, early in the disease course.

In an embodiment, the method comprises initiating treatment of a subject prior to disease onset. In an embodiment, the method comprises initiating treatment of a subject after disease onset. In an embodiment, the method comprises initiating treatment of a subject well after disease onset, e.g., 1, 2, 3, 4, 5, 6, 7, 8, 9, 10, 12, 24, or 36 months after onset of the disease. While not wishing to be bound by theory it is believed that this may be effective if subjects did not present to physician until well into the course of illness.

In an embodiment, the method comprises initiating treatment of a subject in an advanced stage of disease.

Overall, initiation of treatment for subjects at all stages of disease is expected to prevent negative consequences of disease and be of benefit to subjects.

In an embodiment, the method comprises initiating treatment of a subject prior to disease expression. In an embodiment, the method comprises initiating treatment of a subject in an early stage of disease, e.g., when a subject has tested positive for the disease but has no signs or symptoms associated with the disease.

In an embodiment, the method comprises initiating treatment of a subject who has tested positive for the mutation underlying the disease, based on diagnosis via electrophoresis, genotyping, family history or other diagnostic criteria.

EXAMPLES

The following Examples are merely illustrative and are not intended to limit the scope or content of the invention in any way.

Introduction: Pathway Choice after DNA Double-Stranded Break Formation

After the formation of a DNA double-stranded break (DSB), the major decision point affecting DNA repair pathway choice is whether or not the DNA ends are endo- and exonucleolytically processed in a process referred to as end resection (FIG. 1). When no end resection takes places, the repair pathway engaged to repair the DSB is referred to as classical non-homologous end joining (C-NHEJ). The C-NHEJ repair pathway leads to either perfect repair of the DSBs, in which case the locus is restored without sequence alterations, or to the formation of small insertions and deletions.

In contrast, if the end resection machinery processes the DSB, a 3' overhang is exposed, which engages in homology search. When the end resection is extensive, the exposed 3' overhang can undergo strand invasion of highly homologous sequences, followed by repair of the DSB by a homology-dependent recombination (HDR) pathway. The HDR pathway comprises homologous recombination (HR), single strand annealing (SSA), and a potential third, not yet fully characterized alternative-HR pathway ("alt-HR").

Yet another not completely characterized class of pathways that can engage the repair of DSBs after resection is initiated is referred to as alternative non-homologous end joining (ALT-NHEJ). Examples of pathways that are categorized as ALT-NHEJ include blunt end-joining (blunt EJ) and microhomology mediated end joining (MMEJ) leading to deletions, as well as synthesis dependent micro homology mediated end joining (SD-MMEJ), leading to the formation of insertions.

Overview of Different Cas9 Variants and gRNA Combinations

The wild-type (wt) Cas9 enzyme is directed to double-stranded DNA with a gRNA complementary to the desired genomic location, with the only requirement being the presence of a protospacer-adjacent motif (PAM) 3' of the DNA target site. A wt Cas9 molecule then introduces two single nicks on opposite strands through the coordinated catalytic activity of the HNH and RuvC catalytic domains, leading to the formation of a blunt DSB (middle panel of FIG. 2). The HNH domain cleaves the strand complementary to the gRNA, while the RuvC domain places a cleavage event on the non-complementary strand.

Mutations in the HNH or RuvC domains can lead to the inactivation of their respective catalytic activities, thereby preventing the placement of a cleavage event on their respective target DNA strand. For example, a mutation in the RuvC domain of Cas9 (for example the D10A mutation of *S. pyogenes* Cas9) leads to the placement of a cleavage event only on the gRNA complementary strand through the remaining HNH domain activity when a single gRNA is used (upper panel, middle of FIG. 2)). In contrast, an inactivating mutation of the HNH domain (for example the N863A mutation of *S. pyogenes* Cas9) leads to the cleavage of the non-complementary strand by the RuvC domain when a single gRNA is used (lower panel, middle of FIG. 2). The Cas9 catalytic domain mutants can also be used in combination with two gRNAs, which direct the single cleavage events to two different locations. For example, two gRNAs targeting opposite strands, in which PAMs face outwards, lead to the formation of 5' protruding arms with D10A Cas9 mutants (RuvC domain catalytic mutant), in which the HNH domains place cleavage events on the gRNA complementary strands (upper panel, right of FIG. 2). Similarly, two gRNAs that direct the N863A Cas9 nickase (HNH domain catalytic mutant) to two opposite DNA strands in an orientation in which the PAMs face outwards, lead to the formation of 3' protruding arms induced by non-complementary strand cleavage by the RuvC domains (lower panel, right of FIG. 2).

Example 1: Cleavage by Different Cas9 Variants Leads to Different Repair Outcomes The different repair outcomes induced in response to DSBs introduced by different Cas9 variants were examined (FIG. 3). The CRISPR/Cas9 system was used to target the human HBB gene in the region of the sickle cell anemia-causing mutation. Blunt DSBs and dual-nicks in which the nicks are placed on opposite strands and with PAMs facing outwards, leaving either 3' or 5' overhangs as described above and as shown in FIG. 2, were introduced by utilizing the wild type Cas9 nuclease, as well as the N863A or D10A Cas9 nickase mutants. Several different DNA repair outcomes including, e.g., indel mutations resulting from non-homologous end-joining, alternative NHEJ, HDR homologous recombination (HR) using the closely related HBD gene as an endogenous template, or homology dependent repair using an exogenous donor sequence were characterized.

Specifically, U2OS cells were electroporated with 200 ng of each gRNA (HBB-8 and HBB-15), 750 ng of plasmid that encodes wild type Cas9 or mutant Cas9 (D10A or N863A). For some conditions, 50 pmols of single stranded oligonucleotide donor (ss-ODN) was included. Cells were collected 6 days after electroporation and genomic DNA was extracted. PCR amplification of the HBB locus was performed and subcloned into a Topo Blunt Vector. For each condition in each experiment (more the 4 independent samples) 98 colonies were analyses were sequenced with Sanger sequencing and scored for either insertions, deletions, gene conversion or gene corrections. In the absence of an exogenous ss-ODN (FIG. 3), a blunt DSB induced by WT Cas9 leads to the formation of predominantly (~¾ of all editing events) small deletions, followed by gene conversion and insertions. This is consistent with the notion that wt Cas9 generates blunt ends which are preferentially repaired by c-NHEJ.

In contrast, DSBs induced by the N863A nickase mutant that leads to the formation of 3' overhangs with the gRNA configuration used, are predominantly repaired by insertions in which the inserted sequence was a duplication of the overhang sequence (FIG. 3). This repair signature is indicative of repair by the ALT-NHEJ pathway. Lastly, the DSBs harboring a 5' overhang induced by the D10A nickase mutants are predominantly repaired by the gene conversion pathway, which us a subset of the resection dependent HDR pathway. While the overall modification distribution remains similar in the presence of an exogenous ss-ODN (right panel of FIG. 4), we found that the most efficient repair using the ss-ODN as a template occurs in the presence of D10A induced lesions.

In summary, Cas9 nickases (D10A and N863A) showed comparable levels of efficacy compared to wildtype Cas9. However, different DNA ends engage different repair pathways. Wildtype Cas9 generates blunt ends, which are preferentially repaired by canonical NHEJ. Use of a Cas9 nickase with two gRNAs generates either 3' or 5' overhangs, which are most likely not suitable substrates to be repaired by canonical NHEJ but can be repaired by alternative pathways.

The 5' protruding end was mostly repaired through a mechanism called gene conversion in which the HBB gene is repaired by using the HBD locus as a template. In addition, the D10A Nickase leaving a 5' protruding arm is advantageous to promote HDR mediated by SS-ODN.

Example 2: WT Cas9-Induced Blunt DSBs are Repaired Through the C-NHEJ Pathway

In this experiment, the deletions occurring in response to different end structures induced by different Cas9 variants were analyzed. Initially, U2OS cells were electroporated with 200 ng of each gRNA (8 and 15), 750 ng of plasmid that encodes wild type Cas9 or mutant Cas9 (D10A or N863A). Cells were collected 6 days after electroporation and genomic DNA was extracted. PCR amplification of the HBB locus was performed and subcloned into a Topo Blunt Vector. For each condition in each experiment (more the 4 independent samples), 98 colonies were analyses were sequenced with Sanger sequencing. Deletions detected by Sanger sequencing were scored for the exact number of nucleotides deleted. The resulting deletion length data was represented on a histogram plot (FIG. 5).

Deletions occurring in response to blunt DSBs induced by the wt Cas9 molecule are predominantly small in size (green bars), which is indicative of repair through the c-NHEJ pathway. In contrast, the deletions observed in response to the 5' and 3' protruding DSBs induced by the D10A and N863A Cas9 variants were mostly larger in nature, indicating the activity of a different repair process.

Example 3: Modulation of Repair Pathway Choice by Inhibition of C-NHEJ Factors in the Context of a Wild-Type Cas9

Blunt DSBs get most frequently repaired by C-NHEJ, resulting in small deletions. C-NHEJ is a pathway that repairs DSBs that have not undergone extensive end processing by end resection. Many of the main components of the C-NHEJ pathway have been previously characterized (FIG. 6). The proteins 53BP1, Rif1, and PTIP are required for the initial pathway choice by preventing end resection from occurring. Proteins involved in the C-NHEJ repair process itself include the Ku70/Ku80 complex, DNA-PK, Artemis, Ligase 4, XRCC4 and XLF. Transient inhibition or down regulation of the Ku70/Ku80 complex, DNA-PK, Artemis, Ligase 4, XRCC4 and XLF is expected to yield to a shift in the balance from C-NHEJ towards alternative-NHEJ or HDR.

An alternative approach to enhance repair pathways other than C-NHEJ is to downregulate or transiently inhibit the proteins 53BP1, Rif1, and PtIP, which prevent end resection. It is expected that transient inhibition or down regulation of proteins that prevent end resection leads to the initiation of end resection and thereby influences pathway choice towards the resection dependent ALT-NHEJ and HDR pathways. Cells have also evolved pathways to protect against unwanted recombination. These anti-recombination factors include proteins such as Fbh1, RTEL, PARI and Rap80, as well as micro RNAs such as miRNA155, 545, 107, 1255, 148 and 193. A transient inhibition or down regulation of these proteins or inhibition of miRNAs with their respective antisense miRNAs are expected to increase usage of recombination-dependent pathways such as HDR.

Example 4: Overexpression of a Dominant Negative Form of 53BP1 Will Enhance Repair of DSBs by Resection Dependent Pathways U2OS cells are electroporated with 200 ng of each gRNA (8 and 15), 750 ng of plasmid that encodes wild type Cas9, and a plasmid that encodes a dominant negative form of 53BP1 (see sequences, below) or a non-coding control plasmid, as an example of the inhibition of c-NHEJ. Cells are collected 6 days after electroporation and genomic DNA is extracted. PCR amplification of the HBB locus is performed and is subcloned into a Topo Blunt Vector. For each condition in each experiment colonies are sequenced with Sanger sequencing and HDR levels are scored.

53BP1 Dominant Negative Mutant 1: 53bp1_(1221-1718)—with ATG Start and TAA Stop

```
AA-seq
MGEEEFDMPQPPHGHVLHRHMRTIREVRTLVTRVITDVYYVDGTEVERKV
TEETEEPIVECQECETEVSPSQTGGSSGDLGDISSFSSKASSLHRTSSGT
SLSAMHSSGSSGKGAGPLRGKTSGTEPADFALPSSRGGPGKLSPRKGVSQ
TGTPVCEEDGDAGLGIRQGGKAPVTPRGRGRRGRPPSRTTGTRETAVPGP
LGIEDISPNLSPDDKSFSRVVPRVPDSTRRTDVGAGALRRSDSPEIPFQA
AAGPSDGLDASSPGNSFVGLRVVAKWSSNGYFYSGKITRDVGAGKYKLLF
DDGYECDVLGKDILLCDPIPLDTEVTALSEDEYFSAGVVKGHRKESGELY
YSIEKEGQRKWYKRMAVILSLEQGNRLREQYGLGPYEAVTPLTKAADISL
DNLVEGKRKRRSNVSSPATPTASSSSSTTPTRKITESPRASMGVLSGKRK
LITSEEERSPAKRGRKSATVKPGAVGAGEFVSPCESGDNTGEPSALEEQ*

Nucleotide Seq
ATGGGAGAAGAAGAGTTTGATATGCCTCAGCCTCCACATGGCCATGTCTT
ACATCGTCACATGAGAACAATCCGGGAAGTACGCACACTTGTCACTCGTG
TCATTACAGATGTGTATTATGTGGATGGAACAGAAGTAGAAAGAAAAGTA
ACTGAGGAGACTGAAGAGCCAATTGTAGAGTGTCAGGAGTGTGAAACTGA
AGTTTCCCCTTCACAGACTGGGGGCTCCTCAGGTGACCTGGGGGATATCA
GCTCCTTCTCCTCCAAGGCATCCAGCTTACACCGCACATCAAGTGGGACA
AGTCTCTCAGCTATGCACAGCAGTGGAAGCTCAGGGAAAGGAGCCGGACC
ACTCAGAGGGAAAACCAGCGGGACAGAACCCGCAGATTTTGCCTTACCCA
GCTCCCGAGGAGGCCCAGGAAAACTGAGTCCTAGAAAAGGGGTCAGTCAG
ACAGGGACGCCAGTGTGTGAGGAGGATGGTGATGCAGGCCTTGGCATCAG
ACAGGGAGGGAAGGCTCCAGTCACGCCTCGTGGGCGTGGGCGAAGGGGCC
GCCCACCTTCTCGGACCACTGGAACCAGAGAAACAGCTGTGCCTGGCCCC
TTGGGCATAGAGGACATTTCACCTAACTTGTCACCAGATGATAAATCCTT
CAGCCGTGTCGTGCCCCGAGTGCCAGACTCCACCAGACGAACAGATGTGG
GTGCTGGTGCTTTGCGTCGTAGTGACTCTCCAGAAATTCCTTTCCAGGCT
GCTGCTGGCCCTTCTGATGGCTTAGATGCCTCCTCTCCAGGAAATAGCTT
TGTAGGGCTCCGTGTTGTAGCCAAGTGGTCATCCAATGGCTACTTTTACT
CTGGGAAAATCACACGAGATGTCGGAGCTGGGAAGTATAAATTGCTCTTT
GATGATGGGTACGAATGTGATGTGTTGGGCAAAGACATTCTGTTATGTGA
CCCCATCCCGCTGGACACTGAAGTGACGGCCCTCTCGGAGGATGAGTATT
TCAGTGCAGGAGTGGTGAAAGGACATAGGAAGGAGTCTGGGGAACTGTAC
TACAGCATTGAAAAAGAAGGCCAAAGAAAGTGGTATAAGCGAATGGCTGT
CATCCTGTCCTTGGAGCAAGGAAACAGACTGAGAGAGCAGTATGGGCTTG
GCCCCTATGAAGCAGTAACACCTCTTACAAAGGCAGCAGATATCAGCTTA
GACAATTTGGTGGAAGGGAAGCGGAAACGGCGCAGTAACGTCAGCTCCCC
AGCCACCCCTACTGCCTCCAGTAGCAGCAGCACAACCCCTACCCGAAAGA
TCACAGAAAGTCCTCGTGCCTCCATGGGAGTTCTCTCAGGCAAAAGAAAA
CTTATCACTTCTGAAGAGGAACGGTCCCCTGCCAAGCGAGGTCGCAAGTC
TGCCACAGTAAAACCTGGTGCAGTAGGGGCAGGAGAGTTTGTGAGCCCCT
GTGAGAGTGGAGACAACACCGGTGAACCCTCTGCCCTGGAAGAGCAGTAA
```

53BP1 Dominant Negative Mutant 2: 53bp1_(1052-1710)—with ATG Start and TAA Stop

```
AA-seq
MDPPTTPIRGNLLHFPSSQGEEEKEKLEGDHTIRQSQQPMKPISPVKDPV
SPASQKMVIQGPSSPQGEAMVTDVLEDQKEGRSTNKENPSKALIERPSQN
NIGIQTMECSLRVPETVSAATQTIKNVCEQGTSTVDQNFGKQDATVQTER
GSGEKPVSAPGDDTESLHSQGEEEFDMPQPPHGHVLHRHMRTIREVRTLV
TRVITDVYYVDGTEVERKVTEETEEPIVECQECETEVSPSQTGGSSGDLG
DISSFSSKASSLHRTSSGTSLSAMHSSGSSGKGAGPLRGKTSGTEPADFA
LPSSRGGPGKLSPRKGVSQTGTPVCEEDGDAGLGIRQGGKAPVTPRGRGR
RGRPPSRTTGTRETAVPGPLGIEDISPNLSPDDKSFSRVVPRVPDSTRRT
DVGAGALRRSDSPEIPFQAAAGPSDGLDASSPGNSFVGLRVVAKWSSNGY
FYSGKITRDVGAGKYKLLFDDGYECDVLGKDILLCDPIPLDTEVTALSED
EYFSAGVVKGHRKESGELYYSIEKEGQRKWYKRMAVILSLEQGNRLREQY
GLGPYEAVTPLTKAADISLDNLVEGKRKRRSNVSSPATPTASSSSSTTPT
RKITESPRASMGVLSGKRKLITSEEERSPAKRGRKSATVKPGAVGAGEFV
SPCESGDNTG*

Nucleotide Seq
ATGGATCCCCCCACCACACCCATCAGGGGGAACTTGCTCCACTTTCCAAG
TTCTCAAGGAGAAGAGGAGAAAGAAAAATTGGAGGGTGACCATACAATCA
GGCAGAGTCAACAGCCTATGAAGCCCATTAGTCCTGTCAAGGACCCTGTT
TCTCCTGCTTCCCAGAAGATGGTCATACAAGGGCCATCCAGTCCTCAAGG
AGAGGCAATGGTGACAGATGTGCTAGAAGACCAGAAAGAAGGACGGAGTA
CTAATAAGGAAAATCCTAGTAAGGCCTTGATTGAAAGGCCCAGCCAAAAT
AACATAGGAATCCAAACCATGGAGTGTTCCTTGAGGGTCCCAGAAACTGT
TTCAGCAGCAACCCAGACTATAAAGAATGTGTGTGAGCAGGGGACCAGTA
CAGTGGACCAGAACTTTGGAAAGCAAGATGCCACAGTTCAGACTGAGAGG
GGGAGTGGTGAGAAACCAGTCAGTGCTCCTGGGGATGATACAGAGTCGCT
CCATAGCCAGGGAGAAGAAGAGTTTGATATGCCTCAGCCTCCACATGGCC
ATGTCTTACATCGTCACATGAGAACAATCCGGGAAGTACGCACACTTGTC
ACTCGTGTCATTACAGATGTGTATTATGTGGATGGAACAGAAGTAGAAAG
AAAAGTAACTGAGGAGACTGAAGAGCCAATTGTAGAGTGTCAGGAGTGTG
AAACTGAAGTTTCCCCTTCACAGACTGGGGGCTCCTCAGGTGACCTGGGG
GATATCAGCTCCTTCTCCTCCAAGGCATCCAGCTTACACCGCACATCAAG
```

-continued

```
TGGGACAAGTCTCTCAGCTATGCACAGCAGTGGAAGCTCAGGGAAAGGAG

CCGGACCACTCAGAGGGAAAACCAGCGGGACAGAACCCGCAGATTTTGCC

TTACCCAGCTCCCGAGGAGGCCCAGGAAAACTGAGTCCTAGAAAAGGGGT

CAGTCAGACAGGGACGCCAGTGTGTGAGGAGGATGGTGATGCAGGCCTTG

GCATCAGACAGGGAGGGAAGGCTCCAGTCACGCCTCGTGGGCGTGGGCGA

AGGGGCCGCCCACCTTCTCGGACCACTGGAACCAGAGAAACAGCTGTGCC

TGGCCCCTTGGGCATAGAGGACATTTCACCTAACTTGTCACCAGATGATA

AATCCTTCAGCCGTGTCGTGCCCCGAGTGCCAGACTCCACCAGACGAACA

GATGTGGGTGCTGGTGCTTTGCGTCGTAGTGACTCTCCAGAAATTCCTTT

CCAGGCTGCTGCTGGCCCTTCTGATGGCTTAGATGCCTCCTCTCCAGGAA

ATAGCTTTGTAGGGCTCCGTGTTGTAGCCAAGTGGTCATCCAATGGCTAC

TTTTACTCTGGGAAAATCACACGAGATGTCGGAGCTGGGAAGTATAAATT

GCTCTTTGATGATGGGTACGAATGTGATGTGTTGGGCAAAGACATTCTGT

TATGTGACCCCATCCCGCTGGACACTGAAGTGACGGCCCTCTCGGAGGAT

GAGTATTTCAGTGCAGGAGTGGTGAAAGGACATAGGAAGGAGTCTGGGGA

ACTGTACTACAGCATTGAAAAAGAAGGCCAAAGAAAGTGGTATAAGCGAA

TGGCTGTCATCCTGTCCTTGGAGCAAGGAAACAGACTGAGAGAGCAGTAT

GGGCTTGGCCCCTATGAAGCAGTAACACCTCTTACAAAGGCAGCAGATAT

CAGCTTAGACAATTTGGTGGAAGGGAAGCGGAAACGGCGCAGTAACGTCA

GCTCCCCAGCCACCCCTACTGCCTCCAGTAGCAGCAGCACAACCCCTACC

CGAAAGATCACAGAAAGTCCTCGTGCCTCCATGGGAGTTCTCTCAGGCAA

AAGAAAACTTATCACTTCTGAAGAGGAACGGTCCCCTGCCAAGCGAGGTC

GCAAGTCTGCCACAGTAAAACCTGGTGCAGTAGGGGCAGGAGAGTTTGTG

AGCCCCTGTGAGAGTGGAGACAACACCGGTTAA
```

Example 5: Down Regulation of Artemis Expression Leads to Enhanced Gene Correction Efficiency by HDR Artemis is a protein involved in the c-NHEJ repair pathway. To examine whether Artemis plays a role in the repair of CRISPR/Cas9 induced blunt DSBs, Artemis was downregulated using a CRISPR/Cas9 mediated knockout approach (FIG. 7). Specifically, U2OS cells were electroporated with 19 pmols of S. aureus Cas9 complexed with a gRNA directing the Cas9 protein to the Artemis locus. A second set of cells were electroporated with S. aureus Cas9 complexed with non-targeting control gRNA. Samples were collected on day 4 for Western Blot to assess the level of down regulation. On day 7, cells with down regulated Artemis expression and control cells were electroporated with 200 ng of gRNA8, 750 ng of plasmid that encodes wild type Cas9, and 50 pmols of a ss-ODN. Cells were collected 5 days after electroporation and genomic DNA was extracted. PCR amplification of the HBB locus was performed and the resulting products were subcloned into a Topo Blunt Vector. For each condition in each experiment, colonies were sequenced with Sanger sequencing. Upon down regulation of Artemis, an increase in HDR-mediated gene correction efficiency was observed (FIG. 7).

Example 6: Down Regulation of Anti-Recombination Factor Rap80 to Enhance DNA Repair by HDR U2OS cells were electroporated with 200 ng of each gRNA (8 and 15), 750 ng of plasmid that encodes wild type and 30 pmols of an siRNA targeting the Rap80 transcript as an example of down regulation of anti recombination factors or a control siRNA. Cells were collected for a Western Blot assay to check Rap80 protein levels 4 days after electroporation (FIG. 8), and genomic DNA is extracted. PCR amplification of the HBB locus is performed and is subcloned into a Topo Blunt Vector. For each condition in each experiment, colonies are sequenced with Sanger sequencing and HDR levels are scored

Example 7: Modulating Pathway Choice of Cas9 Induced DSBs with 3' Overhangs

N863A Cas9 nickase induced DSBs that lead to the formation of a 3' overhang structure are predominantly repaired using insertions, which is indicative of the ALT-NHEJ pathway (FIG. 9). The ALT-NHEJ pathway comprises of several sub-pathways referred to as blunt end joining (B-EJ), microhomology mediated end joining (MMEJ) and synthesis dependent microhomology mediated end joining (SD-MMEJ). While MMEJ and B-EJ repair outcomes are mostly deletions, insertions are a result of the SD-MMEJ pathway. DNA repair pathway choice can be altered by transiently inhibiting or down regulating components of the ALT-NHEJ pathway, such as XRCC1, Ligase I, Ligase III and Polymerase theta. Upon down regulation or transient inhibition of these ALT-NHEJ components we expect to observe increases in DNA repair by either C-NHEJ or HDR mediated pathways.

Example 8: Down Regulation of Alt-NHEJ Factors to Enhance DNA Repair by HDR

U2OS cells were electroporated with 200 ng of each gRNA (8 and 15), 750 ng of plasmid that encodes N863A Cas9, and 30 pmols of an siRNA targeting the Pol Theta transcript as an example of inhibition of the alt-NHEJ or a control siRNA. Five days after electroporation genomic DNA was extracted. PCR amplification of the HBB locus was performed and products were subcloned into a Topo Blunt Vector. For each condition in each experiment colonies were sequenced with Sanger sequencing.

As shown in FIG. 10, down regulation of Pol theta in the context of the N863A Cas9 nuclease leads to a strong reduction of the insertion frequency and an increase in the gene conversion rate. These data suggest that the 3' protruding ends generated by the N863A Cas9 nuclease are substrates for processing by Pol Theta, resulting in a high accumulation of insertions. Upon down-regulation of Pol Theta, the 3' protruding DNA ends are available for engaging the gene conversion pathway (FIG. 9).

Example 9: Modulating Pathway Choice of Cas9 Induced DSBs with 5' Overhangs in the Presence of a ss-ODN The D10A Cas9 nickase induced DSBs that lead to the formation of 5' overhangs most efficiently incorporate an exogenous ss-ODN donor template among the other Cas9 variants. The factors involved in the repair pathway through which the ss-ODN template is incorporated is incompletely characterized, but falls under the resection dependent homology-dependent (HDR) repair pathway, which includes the SSA, HR, and a potential third, alternative-HR pathway (alt-HR), for which no genetic requirements are yet identified. Factors involved in the HR pathway include Brca1, CtiP, Exo1, Brca2 and Rad51 (FIG. 11). By transiently inhibiting or down regulating factors involved in HR, an increase in SSA repair events should be observed, if HR and SSA are indeed competitive pathways. Also, a decrease in gene conversion upon down regulation or inhibition of HR factors is expected if gene conversion is in fact dependent in HR. If the ss-ODN incorporation is mediated through the SSA annealing pathway, an increase in in ss-ODN incorporation upon the transient inhibition or down regulation of HR components is expected, if HR and SSA are indeed competitive pathways.

Proteins involved in the SSA pathway include Rad52, ERCC1, XPF (SSA), and Ligase 1 (FIG. 11). By transiently inhibiting or down regulating factors involved in SSA, an increase in HR repair events is expected, if HR and SSA are indeed competitive pathways. If the ss-ODN incorporation is dependent on the SSA pathway, a decrease of donor integration upon transient inhibition or down regulation of the SSA pathway is expected. In contrast, if the donor integration is dependent on components of the HR pathway, and if SSA is indeed competing with the HR pathway, we expect to observe an increase in ss-ODN integration upon SSA pathway down regulation or inhibition.

Example 10: Down Regulation of HR Factors to Address the Mechanism of Gene Conversion Repair Whether gene conversion in the context of the D10A Cas9 with 2 gRNAs is dependent on the HR pathway was evaluated (FIG. 12). U2OS cell were electroporated with 200 ng of each gRNA (8 and 15), 750 ng of plasmid that encodes D10A Cas9 and 30 pmol of scrambled siRNA as a negative control or 30 pmol of siRNA against BRCA2 or Rad51—central players of canonical HR—as an example, with or without 50 pmols of a ss-ODN. Five days after electroporation genomic DNA was extracted. PCR amplification of the HBB locus was performed and products were subcloned into a Topo Blunt Vector. For each condition in each experiment colonies were sequenced with Sanger sequencing.

As shown in FIG. 12, the majority of the gene conversion events were mediated by BRCA2 and Rad51. These data are consistent with the notion that gene conversion using the HBD gene as a donor in cis is an event mediated by canonical HR. Rad51 and BRCA2 do not seams to effect the repair mediated by ss-ODN.

Figure 13B:
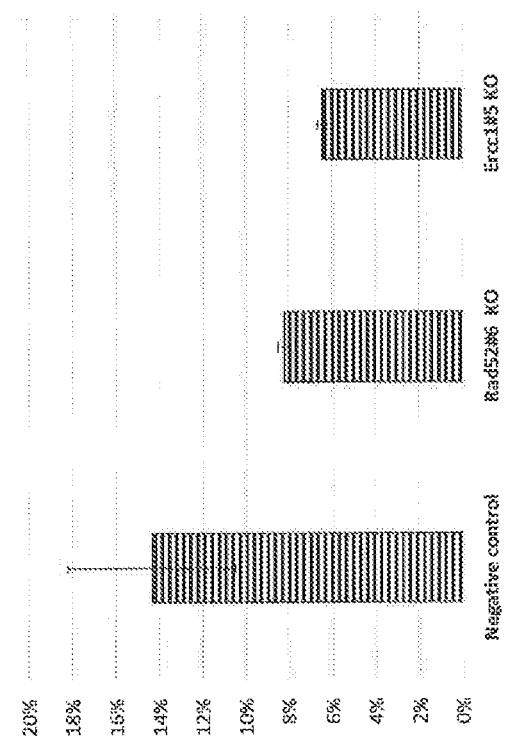

Example 11: Down Regulation of SSA Factors to Address the Mechanism of Gene Correction Repair Next, whether the gene correction in the context of the D10A with 2 gRNA was dependent on the Single Strand Annealing (SSA) pathway was evaluated (FIG. 13). Specifically, U2OS cells were electroporated with 19 pmols of S. aureus Cas9 complexes with different gRNAs directing the Cas9 protein to the ERCC1 and Rad52 locus, as an example of SSA components. A second set of cells were electroporated with S. aureus Cas9 complexed with a non-targeting control gRNAs. Samples were collected on day 4 for Western Blot to assess the level of down regulation (FIG. 13, panel B). On day 7, cells with down regulated ERCC1 or Rad52 expression and control cells were electroporated with 200 ng of gRNA8, 750 ng of plasmid that encodes D10A Cas9, with or without 50 pmols of a ss-ODN. Cells were collected 5 days after electroporation, and genomic DNA was extracted. PCR amplification of the HBB locus was performed and the resulting products were subcloned into a Topo Blunt Vector. For each condition in each experiment, colonies were sequenced with Sanger. A significant reduction in gene correction upon down regulation of the SSA pathway was observed, but not a complete elimination, suggesting that either the cells were not fully knocked down or indicative indeed of a presence of a third, alt-HR pathway.

Example 12: Down Regulation of HR Factors to Address the Mechanism of Gene Conversion Repair Whether gene conversion in the context of the D10A Cas9 with 2 gRNAs is dependent on the canonical HR pathway was evaluated (FIG. 11). U2OS cell were electroporated with 200 ng of each gRNA (HBB-8 and HBB-15), 750 ng of plasmid that encodes D10A Cas9 and 30 pmol of scrambled siRNA as a negative control or 30 pmol of siRNA against Exo1—a key end resection factor required for exposing ssDNA overhangs—as an example, with or without 50 pmols of a ss-ODN. Cells were collected for Western Blot analysis on day 4. Five days after electroporation genomic DNA was extracted. PCR amplification of the HBB locus was performed and products were subcloned into a Topo Blunt Vector. For each condition in each experiment colonies were sequenced with Sanger sequencing.

As shown in the left panel of FIG. 14, gene conversion was unexpectedly increased in the absence of Exo1. To confirm these unexpected results, a CRISPR/Cas9 mediated knockout approach against Exo1 was utilized. Specifically, U2OS cells were electroporated with 19 pmols of S. aureus Cas9 complexes with a gRNAs directing the Cas9 protein to the Exo1 locus. A second set of cells were electroporated with S. aureus Cas9 complexed with a non-targeting control gRNAs. Samples were collected on day 4 for Western Blot to assess the level of down regulation (FIG. 14, right panel). On day 7, cells with down regulated Exo1 expression and control cells were electroporated with 200 ng of gRNA8, 750 ng of plasmid that encodes D10A Cas9. Cells were collected 5 days after electroporation and genomic DNA was extracted. PCR amplification of the HBB locus was performed and the resulting products were subcloned into a Topo Blunt Vector. For each condition in each experiment, colonies were sequenced with Sanger. Again, an increase in gene conversion frequency upon down regulation of Exo1 with the CRISPR/Cas9 system was observed.

Example 13: Modulating Pathway Choice of Cas9-Induced DSBs by Modulation of Epigenetic Modifiers DSB repair is characterized by a its surrounding chromatin structure. A blunt DSB that is most frequently repaired by the C-NHEJ pathway is associated with a distinct signature of chromatin modifications that promote the pathway choice decision for a cell to undergo C-NHEJ. By modulating the factors responsible for placing or removing chromatin marks that impact on the pathway choice decision towards C-NHEJ, the repair balance should shift towards resection dependent pathways such as ALT-NHEJ or HDR. For example, proteins that affect DNA repair pathway choice include KDM4A, Setd2, HDAC1, HDAC2, and EZH2. By modulating the activity of these factors the balance of repair pathway choice should be altered.

Example 14: HDAC1 Inhibitor Treatment

U2OS cells were electroporated with 200 ng of each gRNA (HBB-8 and HBB-15), 750 ng of plasmid that encodes wild type, D10A, or N863A Cas9, and an inhibitor against HDAC1 (Trichostatin A (TSA) or Sodium Butyrate (NaB), for example). Cells are collected 6 days after electroporation and genomic DNA is extracted. PCR amplification of the HBB locus is performed and is subcloned into a Topo Blunt Vector. For each condition in each experiment colonies are sequenced with Sanger sequencing and HDR levels are scored.

Example 15: Table of Reagents

The below table lists siRNAs that may be useful in the described compositions and methods.

| Gene | Catalog | Item |
|---|---|---|
| BRCA2 | M-003462-01-0005 | siGENOME Human BRCA2 (675) siRNA - SMARTpool, 5 nmol |
| Exo1 | L-013120-00-0005 | ON-TARGETplus Human EXO1 (9156) siRNA - SMARTpool, 5 nmol |
| Rap80 | L-006995-00-0005 | ON-TARGETplus Human UIMC1-Rap80 (51720) siRNA - SMARTpool, 5 nmol |
| Rap80 | M-006995-03-0005 | siGENOME Human UIMC1 (51720) siRNA - SMARTpool, 5 nmol |
| Rad51 | D-003530-05-0005 | siGENOME Human RAD51 (5888) siRNA - Individual, 5 nmol |
| Rad51 | D-003530-07-0005 | siGENOME Human RAD51 (5888) siRNA - Individual, 5 nmol |
| FF | CGUACGCGGAAUACUUCGAUU | FF: siRNA, Standard 0.015 µmol Regular |
| PolQ | SI00090062 | Hs_POLQ_1 FlexiTube siRNA, NM_006596, NM_199420 |

The below table lists some exemplary gRNAs for use in the described compositions and methods.

| Gene ID | Gene name | Target |
|---|---|---|
| 10721 | POLQ_1_WS147 | GGAGTGGGAAACGGCGGCGTT |
| 10721 | POLQ_2_WS148 | GTGCCAGCCCCCAGTTCCTCT |
| 10721 | POLQ_3_WS149 | GTGTCACCGCCGCTTCCCGAGA |
| 5893 | Rad52_gRNA#3 (Exon1) | AGGATGGCTGTCACGTCCTCC |
| 5893 | Rad52_gRNA#4 (Exon1) | ACACTGAGCCGCCGCCAGCAG |
| 5893 | Rad52_gRNA#5 (Exon 1) | TGTGGTTCCTTCATGCCGGGA |
| 5893 | Rad52_gRNA#6 (Exon 1) | GCCGGGAAAGAATGAGGTGAA |
| 5893 | Rad52_gRNA#7 (Exon2) | ACATAAGTAGCCGCATGGCTG |
| 5893 | Rad52_gRNA#8 (Exon2) | CCCTGAGGCAGAGGCTGGGCC |
| 5893 | Rad52_gRNA#9 (Exon2) | CAGCCTCTGCCTCAGGGCCTT |
| 5893 | Rad52_gRNA#10 (Exon2) | TGCAGTGCCAGTACACAGCAG |
| 9156 | Exo1_gRNA#3 | AATTTGGCACCATGGGGATAC |
| 9156 | Exo1_gRNA#4 | CCTTTATACTTCCTCACATGG |
| 64421 | DCLRE1C_gRNA4 | CGAAGCGGTCTATGGAGATAG |
| 64421 | DCLRE1C_gRNA5 | TCCTGTCCCACTGCCACAAAG |
| 4361 | Mre11A_gRNA#4 | TAGTTGCAACAGATATTCATC |
| 4361 | Mre11A_gRNA#5 | TGGGCAAGTCTTAAAATTTCA |
| 4361 | Mre11A_gRNA#6 | ATCTTTCTCCATAAATCCAAG |
| 2067 | ERCC1_gRNA_1 | GGAGGGACCTCATCCTCGTCG |
| 2067 | ERCC1_gRNA_2 | GCACCCCTCTTTGTCCTTCC |
| 2067 | ERCC1_gRNA_3 | AAGAGGGGTGCCCCAGCCCT |
| 2067 | ERCC1_gRNA_4 | AAATTTGTGATACCCCTCGAC |
| 2067 | ERCC1_gRNA_5 | CGACGAGGATGAGGTCCCTCC |
| 5932 | RBBP8_1_WS143 | GTAAAGTCACTAGATGTATCTG |
| 5932 | RBBP8_2_WS144 | GAGGACCTTTGGACAAAACTAA | gRNA use to target the HBB locus and evaluate the different DNA repair responses

| HBB-8 | GUAACGGCAGACUUCUCCUC | 5 |
| HBB-15 | AAGGUGAACGUGGAUGAAGU | |

Amino acid sequences described herein:

SEQ ID NO: 6

MKRNYILGLDIGITSVGYGIIDYETRDVIDAGVRLFKEANVENNEGRRSKRGARRLKRRRRHRIQRVKKLLFDYNLLTDHSEL
SGINPYEARVKGLSQKLSEEEFSAALLHLAKRRGVHNVNEVEEDTGNELSTKEQISRNSKALEEKYVAELQLERLKKDGEVRG
SINRFKTSDYVKEAKQLLKVQKAYHQLDQSFIDTYIDLLETRRTYYEGPGEGSPFGWKDIKEWYEMLMGHCTYFPEELRSVKY
AYNADLYNALNDLNNLVITRDENEKLEYYEKFQIIENVFKQKKKPTLKQIAKEILVNEEDIKGYRVTSTGKPEFTNLKVYHDI
KDITARKEIIENAELLDQIAKILTIYQSSEDIQEELTNLNSELTQEEIEQISNLKGYTGTHNLSLKAINLILDELWHTNDNQI
AIFNRLKLVPKKVDLSQQKEIPTTLVDDFILSPVVKRSFIQSIKVINAIIKKYGLPNDIIIELAREKNSKDAQKMINEMQKRN
RQTNERIEEIIRTTGKENAKYLIEKIKLHDMQEGKCLYSLEAIPLEDLLNNPFNYEVDHIIPRSVSFDNSFNNKVLVKQEENS
KKGNRTPFQYLSSSDSKISYETFKKHILNLAKGKGRISKTKKEYLLEERDINRFSVQKDFINRNLVDTRYATRGLMNLLRSYF
RVNNLDVKVKSINGGFTSFLRRKWKFKKERNKGYKHHAEDALIIANADFIFKEWKKLDKAKKVMENQMFEEKQAESMPEIETE
QEYKEIFITPHQIKHIKDFKDYKYSHRVDKKPNRELINDTLYSTRKDDKGNTLIVNNLNGLYDKDNDKLKKLINKSPEKLLMY
HHDPQTYQKLKLIMEQYGDEKNPLYKYYEETGNYLTKYSKKDNGPVIKKIKYYGNKLNAHLDITDDYPNSRNKVVKLSLKPYR
FDVYLDNGVYKFVTVKNLDVIKKENYYEVNSKCYEEAKKLKKISNQAEFIASFYNNDLIKINGELYRVIGVNNDLLNRIEVNM
IDITYREYLENMNDKRPPRIIKTIASKTQSIKKYSTDILGNLYEVKSKKHPQIIKKG

SEQ ID NO: 7

MDKKYSIGLDIGTNSVGWAVITDEYKVPSKKFKVLGNTDRHSIKKNLIGALLFDSGETAEATRLKRTARRRYTRRKNRICYLQ
EIFSNEMAKVDDSFFHRLEESFLVEEDKKHERHPIFGNIVDEVAYHEKYPTIYHLRKKLVDSTDKADLRLIYLALAHMIKFRG
HFLIEGDLNPDNSDVDKLFIQLVQTYNQLFEENPINASGVDAKAILSARLSKSRRLENLIAQLPGEKKNGLFGNLIALSLGLT
PNFKSNFDLAEDAKLQLSKDTYDDDLDNLLAQIGDQYADLFLAAKNLSDAILLSDILRVNTEITKAPLSASMIKRYDEHHQDL
TLLKALVRQQLPEKYKEIFFDQSKNGYAGYIDGGASQEEFYKFIKPILEKMDGTEELLVKLNREDLLRKQRTFDNGSIPHQIH
LGELHAILRRQEDFYPFLKDNREKIEKILTFRIPYYVGPLARGNSRFAWMTRKSEETITPWNFEEVVDKGASAQSFIERMTNF
DKNLPNEKVLPKHSLLYEYFTVYNELTKVKYVTEGMRKPAFLSGEQKKAIVDLLFKTNRKVTVKQLKEDYFKKIECFDSVEIS
GVEDRFNASLGTYHDLLKIIKDKDFLDNEENEDILEDIVLTLTLFEDREMIEERLKTYAHLFDDKVMKQLKRRRYTGWGRLSR
KLINGIRDKQSGKTILDFLKSDGFANRNFMQLIHDDSLTFKEDIQKAQVSGQGDSLHEHIANLAGSPAIKKGILQTVKVVDEL
VKVMGRHKPENIVIEMARENQTTQKGQKNSRERMKRIEEGIKELGSQILKEHPVENTQLQNEKLYLYYLQNGRDMYVDQELDI
NRLSDYDVDHIVPQSFLKDDSIDNKVLTRSDKNRGKSDNVPSEEVVKKMKNYWRQLLNAKLITQRKFDNLTKAERGGLSELDK
AGFIKRQLVETRQITKHVAQILDSRMNTKYDENDKLIREVKVITLKSKLVSDFRKDFQFYKVREINNYHHAHDAYLNAVVGTA
LIKKYPKLESEFVYGDYKVYDVRKMIAKSEQEIGKATAKYFFYSNIMNFFKTEITLANGEIRKRPLIETNGETGEIVWDKGRD
FATVRKVLSMPQVNIVKKTEVQTGGFSKESILPKRNSDKLIARKKDWDPKKYGGFDSPTVAYSVLVVAKVEKGKSKKLKSVKE
LLGITIMERSSFEKNPIDFLEAKGYKEVKKDLIIKLPKYSLFELENGRKRMLASAGELQKGNELALPSKYVNFLYLASHYEKL
KGSPEDNEQKQLFVEQHKHYLDEIIEQISEFSKRVILADANLDKVLSAYNKHRDKPIREQAENIIHLFTLTNLGAPAAFKYFD
TTIDRKRYTSTKEVLDATLIHQSITGLYETRIDLSQLGGD

SEQ ID NO: 8

MARILAFDIGISSIGWAFSENDELKDCGVRIFTKVENPKTGESLALPRRLARSARKRLARRKARLNHLKHLIANEFKLNYEDY
QSFDESLAKAYKGSLISPYELRFRALNELLSKQDFARVIHIAKRRGYDDIKNSDDKEKGAILKAIKQNEEKLANYQSVGEYL
YKEYFQKFKENSKEFTNVRNKKESYERCIAQSFLKDELKLIFKKQREFGFSFSKKFEEEVLSVAFYKRALKDFSHLVGNCSFF
TDEKRAPKNSPLAFMFVALTRIINLLNNLKNTEGILYTKDDLNALLNEVLKNGTLTYKQTKKLLGLSDDYEFKGEKGTYFIEF

-continued

KKYKEFIKALGEHNLSQDDLNEIAKDITLIKDEIKLKKALAKYDLNQNQIDSLSKLEFKDHLNISFKALKLVTPLMLEGKKYD

EACNELNLKVAINEDKKDFLPAFNETYYKDEVTNPVVLRAIKEYRKVLNALLKKYGKVHKINIELAREVGKNHSQRAKIEKEQ

NENYKAKKDAELECEKLGLKINSKNILKLRLFKEQKEFCAYSGEKIKISDLQDEKMLEIDHIYPYSRSFDDSYMNKVLVFTKQ

NQEKLNQTPFEAFGNDSAKWQKIEVLAKNLPTKKQKRILDKNYKDKEQKNFKDRNLNDTRYIARLVLNYTKDYLDFLPLSDDE

NTKLNDTQKGSKVHVEAKSGMLTSALRHTWGFSAKDRNNHLHHAIDAVIIAYANNSIVKAFSDFKKEQESNSAELYAKKISEL

DYKNKRKFFEPFSGFRQKVLDKIDEIFVSKPERKKPSGALHEETFRKEEEFYQSYGGKEGVLKALELGKIRKVNGKIVKNGDM

FRVDIFKHKKTNKFYAVPIYTMDFALKVLPNKAVARSKKGEIKDWILMDENYEFCFSLYKDSLILIQTKDMQEPEFVYYNAFT

SSTVSLIVSKHDNKFETLSKNQKILFKNANEKEVIAKSIGIQNLKVFEKYIVSALGEVTKAEFRQREDFKK

SEQ ID NO: 9

MKRILGLDLGTNSIGWALVNEAENKDERSSIVKLGVRVNPLTVDELTNFEKGKSITTNADRTLKRGMRRNLQRYKLRRETLTE

VLKEHKLITEDTILSENGNRTTFETYRLRAKAVTEEISLEEFARVLLMINKKRGYKSSRKAKGVEEGTLIDGMDIARELYNNN

LTPGELCLQLLDAGKKFLPDFYRSDLQNELDRIWEKQKEYYPEILTDVLKEELRGKKRDAVWAICAKYFVWKENYTEWNKEKG

KTEQQEREHKLEGIYSKRKRDEAKRENLQWRVNGLKEKLSLEQLVIVFQEMNTQINNSSGYLGAISDRSKELYFNKQTVGQYQ

MEMLDKNPNASLRNMVFYRQDYLDEFNMLWEKQAVYHKELTEELKKEIRDIIIFYQRRLKSQKGLIGFCEFESRQIEVDIDGK

KKIKTVGNRVISRSSPLFQEFKIWQILNNIEVIVVGKKRKRRKLKENYSALFEELNDAEQLELNGSRRLCQEEKELLAQELFI

RDKMTKSEVLKLLFDNPQELDLNFKTIDGNKTGYALFQAYSKMIEMSGHEPVDFKKPVEKVVEYIKAVFDLLNWNTDILGFNS

NEELDNQPYYKLWHLLYSFEGDNTPTGNGRLIQKMTELYGFEKEYATILANVSFQDDYGSLSAKAIHKILPHLKEGNRYDVAC

VYAGYRHSESSLTREEIANKVLKDRLMLLPKNSLHNPVVEKILNQMVNVINVIIDIYGKPDEIRVELARELKKNAKEREELTK

SIAQTTKAHEEYKTLLQTEFGLTNVSRTDILRYKLYKELESCGYKTLYSNTYISREKLFSKEFDIEHIIPQARLFDDSFSNKT

LEARSVNIEKGNKTAYDFVKEKFGESGADNSLEHYLNNIEDLFKSGKISKTKYNKLKMAEQDIPDGFIERDLRNTQYIAKKAL

SMLNEISHRVVATSGSVTDKLREDWQLIDVMKELNWEKYKALGLVEYFEDRDGRQIGRIKDWTKRNDHRHHAMDALTVAFTKD

VFIQYFNNKNASLDPNANEHAIKNKYFQNGRAIAPMPLREFRAEAKKHLENTLISIKAKNKVITGNINKTRKKGGVNKNMQQT

PRGQLHLETIYGSGKQYLTKEEKVNASFDMRKIGTVSKSAYRDALLKRLYENDNDPKKAFAGKNSLDKQPIWLDKEQMRKVPE

KVKIVTLEAIYTIRKEISPDLKVDKVIDVGVRKILIDRLNEYGNDAKKAFSNLDKNPIWLNKEKGISIKRVTISGISNAQSLH

VKKKDKDGKPILDENGRNIPVDFVNTGNNHHVAVYYRPVIDKRGQLVVDEAGNPKYELEEVVVSFFEAVTRANLGLPIIDKDYK

TTEGWQFLFSMKQNEYFVFPNEKTGFNPKEIDLLDVENYGLISPNLFRVQKFSLKNYVFRHHLETTIKDTSSILRGITWIDFR

SSKGLDTIVKVRVNHIGQIVSVGEY

SEQ ID NO: 10

MSRKNYVDDYAISLDIGNASVGWSAFTPNYRLVRAKGHELIGVRLFDPADTAESRRMARTTRRRYSRRRWRLRLLDALFDQAL

SEIDPSFLARRKYSWVHPDDENNADCWYGSVLFDSNEQDKRFYEKYPTIYHLRKALMEDDSQHDIREIYLAIHHMVKYRGNFL

VEGTLESSNAFKEDELLKLLGRITRYEMSEGEQNSDIEQDDENKLVAPANGQLADALCATRGSRSMRVDNALEALSAVNDLSR

EQRAIVKAIFAGLEGNKLDLAKIFVSKEFSSENKKILGIYFNKSDYEEKCVQIVDSGLLDDEEREFLDRMQGQYNAIALKQLL

GRSTSVSDSKCASYDAHRANWNLIKLQLRTKENEKDINENYGILVGWKIDSGQRKSVRGESAYENMRKKANVFFKKMIETSDL

SETDKNRLIHDIEEDKLFPIQRDSDNGVIPHQLHQNELKQIIKKQGKYYPFLLDAFEKDGKQINKIEGLLTFRVPYFVGPLVV

PEDLQKSDNSENHWMVRKKKGEITPWNFDEMVDKDASGRKFIERLVGTDSYLLGEPTLPKNSLLYQEYEVLNELNNVRLSVRT

GNHWNDKRRMRLGREEKTLLCQRLFMKGQTVTKRTAENLLRKEYGRTYELSGLSDESKFTSSLSTYGKMCRIFGEKYVNEHRD

LMEKIVELQTVFEDKETLLHQLRQLEGISEADCALLVNTHYTGWGRLSRKLLTTKAGECKISDDFAPRKHSIIEIMRAEDRNL

MEIITDKQLGFSDWIEQENLGAENGSSLMEVVDDLRVSPKVKRGIIQSIRLIDDISKAVGKRPSRIFLELADDIQPSGRTISR

KSRLQDLYRNANLGKEFKGIADELNACSDKDLQDDRLFLYYTQLGKDMYTGEELDLDRLSSAYDIDHIIPQAVTQNDSIDNRV

LVARAENARKTDSFTYMPQIADRMRNFWQILLDNGLISRVKFERLTRQNEFSEREKERFVQRSLVETRQIMKNVATLMRQRYG

NSAAVIGLNAELTKEMHRYLGFSHKNRDINDYHHAQDALCVGIAGQFAANRGFFADGEVSDGAQNSYNQYLRDYLRGYREKLS

-continued

AEDRKQGRAFGFIVGSMRSQDEQKRVNPRTGEVVWSEEDKDYLRKVMNYRKMLVTQKVGDDFGALYDETRYAATDPKGIKGIP

FDGAKQDTSLYGGFSSAKPAYAVLIESKGKTRLVNVTMQEYSLLGDRPSDDELRKVLAKKKSEYAKANILLRHVPKMQLIRYG

GGLMVIKSAGELNNAQQLWLPYEEYCYFDDLSQGKGSLEKDDLKKLLDSILGSVQCLYPWHRFTEEELADLHVAFDKLPEDEK

KNVITGIVSALHADAKTANLSIVGMTGSWRRMNNKSGYTFSDEDEFIFQSPSGLFEKRVTVGELKRKAKKEVNSKYRTNEKRL

PTLSGASQP

SEQ ID NO: 11

METQTSNQLITSHLKDYPKQDYFVGLDIGTNSVGWAVTNTSYELLKFHSHKMWGSRLFEEGESAVTRRGFRSMRRRLERRKLR

LKLLEELFADAMAQVDSTFFIRLHESKYHYEDKTTGHSSKHILFIDEDYTDQDYFTEYPTIYHLRKDLMENGTDDIRKLFLAV

HHILKYRGNFLYEGATFNSNAFTFEDVLKQALVNITFNCFDTNSAISSISNILMESGKTKSDKAKAIERLVDTYTVFDEVNTP

DKPQKEQVKEDKKTLKAFANLVLGLSANLIDLFGSVEDIDDDLKKLQIVGDTYDEKRDELAKVWGDEIHIIDDCKSVYDAIIL

MSIKEPGLTISQSKVKAFDKHKEDLVILKSLLKLDRNVYNEMFKSDKKGLHNYVHYIKQGRTEETSCSREDFYKYTKKIVEGL

ADSKDKEYILNEIELQTLLPLQRIKDNGVIPYQLHLEELKVILDKCGPKFPFLHTVSDGFSVTEKLIKMLEFRIPYYVGPLNT

HHNIDNGGFSWAVRKQAGRVTPWNFEEKIDREKSAAAFIKNLTNKCTYLFGEDVLPKSSLLYSEFMLLNELNNVRIDGKALAQ

GVKQHLIDSIFKQDHKKMTKNRIELFLKDNNYITKKHKPEITGLDGEIKNDLTSYRDMVRILGNNFDVSMAEDIITDITIFGE

SKKMLRQTLRNKFGSQLNDETIKKLSKLRYRDWGRLSKKLLKGIDGCDKAGNGAPKTIIELMRNDSYNLMEILGDKFSFMECI

EEENAKLAQGQVVNPHDIIDELALSPAVKRAVWQALRIVDEVAHIKKALPSRIFVEVARTNKSEKKKKDSRQKRLSDLYSAIK

KDDVLQSGLQDKEFGALKSGLANYDDAALRSKKLYLYYTQMGRCAYTGNIIDLNQLNTDNYDIDHIYPRSLTKDDSFDNLVLC

ERTANAKKSDIYPIDNRIQTKQKPFWAFLKHQGLISERKYERLTRIAPLTADDLSGFIARQLVETNQSVKATTTLLRRLYPDI

DVVFVKAENVSDFRHNNNFIKVRSLNHHHHAKDAYLNIVVGNVYHEKFTRNFRLFFKKNGANRTYNLAKMFNYDVICTNAQDG

KAWDVKTSMNTVKKMMASNDVRVTRRLLEQSGALADATIYKASVAAKAKDGAYIGMKTKYSVFADVTKYGGMTKIKNAYSIIV

QYTGKKGEEIKEIVPLPIYLINRNATDIELIDYVKSVIPKAKDISIKYRKLCINQLVKVNGFYYYLGGKTNDKIYIDNAIELV

VPHDIATYIKLLDKYDLLRKENKTLKASSITTSIYNINTSTVVSLNKVGIDVFDYFMSKLRTPLYMKMKGNKVDELSSTGRSK

FIKMTLEEQSIYLLEVLNLLTNSKTTFDVKPLGITGSRSTIGVKIHNLDEFKIINESITGLYSNEVTIV

SEQ ID NO: 12

MTKLNQPYGIGLDIGSNSIGFAVVDANSHLLRLKGETAIGARLFREGQSAADRRGSRTTRRRLSRTRWRLSFLRDFFAPHITK

IDPDFFLRQKYSEISPKDKDRFKYEKRLFNDRTDAEFYEDYPSMYHLRLHLMTHTHKADPREIFLAIHHILKSRGHFLTPGAA

KDFNTDKVDLEDIFPALTEAYAQVYPDLELTFDLAKADDFKAKLLDEQATPSDTQKALVNLLLSSDGEKEIVKKRKQVLTEFA

KAITGLKTKFNLALGTEVDEADASNWQFSMGQLDDKWSNIETSMTDQGTEIFEQIQELYRARLLNGIVPAGMSLSQAKVADYG

QHKEDLELFKTYLKKLNDHELAKTIRGLYDRYINGDDAKPFLREDFVKALTKEVTAHPNEVSEQLLNRMGQANFMLKQRTKAN

GAIPIQLQQRELDQIIANQSKYYDWLAAPNPVEAHRWKMPYQLDELLNFHIPYYVGPLITPKQQAESGENVFAWMVRKDPSGN

ITPYNFDEKVDREASANTFIQRMKTTDTYLIGEDVLPKQSLLYQKYEVLNELNNVRINNECLGTDQKQRLIREVFERHSSVTI

KQVADNLVAHGDFARRPEIRGLADEKRFLSSLSTYHQLKEILHEAIDDPTKLLDIENIITWSTVFEDHTIFETKLAEIEWLDP

KKINELSGIRYRGWGQFSRKLLDGLKLGNGHTVIQELMLSNHNLMQILADETLKETMTELNQDKLKTDDIEDVINDAYTSPSN

KKALRQVLRVVEDIKHAANGQDPSWLFIETADGTGTAGKRTQSRQKQIQTVYANAAQELIDSAVRGELEDKIADKASFTDRLV

LYFMQGGRDIYTGAPLNIDQLSHYDIDHILPQSLIKDDSLDNRVLVNATINREKNNVFASTLFAGKMKATWRKWHEAGLISGR

KLRNLMLRPDEIDKFAKGFVARQLVETRQIIKLTEQIAAAQYPNTKIIAVKAGLSHQLREELDFPKNRDVNHYHHAFDAFLAA

RIGTYLLKRYPKLAPFFTYGEFAKVDVKKFREFNFIGALTHAKKNIIAKDTGEIVWDKERDIRELDRIYNFKRMLITHEVYFE

TADLFKQTIYAAKDSKERGGSKQLIPKKQGYPTQVYGGYTQESGSYNALVRVAEADTTAYQVIKISAQNASKIASANLKSREK

GKQLLNEIVVKQLAKRRKNWKPSANSFKIVIPRFGMGTLFQNAKYGLFMVNSDTYYRNYQELWLSRENQKLLKKLFSIKYEKT

QMNHDALQVYKAIIDQVEKFFKLYDINQFRAKLSDAIERFEKLPINTDGNKIGKTETLRQILIGLQANGTRSNVKNLGIKTDL

GLLQVGSGIKLDKDTQIVYQSPSGLFKRRIPLADL

SEQ ID NO: 13

MTKEYYLGLDVGTNSVGWAVTDSQYNLCKFKKKDMWGIRLFESANTAKDRRLQRGNRRRLERKKQRIDLLQEIFSPEICKIDP
TFFIRLNESRLHLEDKSNDFKYPLFIEKDYSDIEYYKEFPTIFHLRKHLIESEEKQDIRLIYLALHNIIKTRGHFLIDGDLQS
AKQLRPILDTFLLSLQEEQNLSVSLSENQKDEYEEILKNRSIAKSEKVKKLKNLFEISDELEKEEKKAQSAVIENFCKFIVGN
KGDVCKFLRVSKEELEIDSFSFSEGKYEDDIVKNLEEKVPEKVYLFEQMKAMYDWNILVDILETEEYISFAKVKQYEKHKTNL
RLLRDIILKYCTKDEYNRMFNDEKEAGSYTAYVGKLKKNNKKYWIEKKRNPEEFYKSLGKLLDKIEPLKEDLEVLTMMIEECK
NHTLLPIQKNKDNGVIPHQVHEVELKKILENAKKYYSFLTETDKDGYSVVQKIESIFRFRIPYYVGPLSTRHQEKGSNVWMVR
KPGREDRIYPWNMEEIIDFEKSNENFITRMTNKCTYLIGEDVLPKHSLLYSKYMVLNELNNVKVRGKKLPTSLKQKVFEDLFE
NKSKVTGKNLLEYLQIQDKDIQIDDLSGFDKDFKTSLKSYLDFKKQIFGEEIEKESIQNMIEDIIKWITIYGNDKEMLKRVIR
ANYSNQLTEEQMKKITGFQYSGWGNFSKMFLKGISGSDVSTGETFDIITAMWETDNNLMQILSKKFTFMDNVEDFNSGKVGKI
DKITYDSTVKEMFLSPENKRAVWQTIQVAEEIKKVMGCEPKKIFIEMARGGEKVKKRTKSRKAQLLELYAACEEDCRELIKEI
EDRDERDFNSMKLFLYYTQFGKCMYSGDDIDINELIRGNSKWDRDHIYPQSKIKDDSIDNLVLVNKTYNAKKSNELLSEDIQK
KMHSFWLSLLNKKLITKSKYDRLTRKGDFTDEELSGFIARQLVETRQSTKAIADIFKQIYSSEVVYVKSSLVSDFRKKPLNYL
KSRRVNDYHHAKDAYLNIVVGNVYNKKFTSNPIQWMKKNRDTNYSLNKVFEHDVVINGEVIWEKCTYHEDTNTYDGGTLDRIR
KIVERDNILYTEYAYCEKGELFNATIQNKNGNSTVSLKKGLDVKKYGGYFSANTSYFSLIEFEDKKGDRARHIIGVPIYIANM
LEHSPSAFLEYCEQKGYQNVRILVEKIKKNSLLIINGYPLRIRGENEVDTSFKRAIQLKLDQKNYELVRNIEKFLEKYVEKKG
NYPIDENRDHITHEKMNQLYEVLLSKMKKFNKKGMADPSDRIEKSKPKFIKLEDLIDKINVINKMLNLLRCDNDTKADLSLIE
LPKNAGSFVVKKNTIGKSKIILVNQSVTGLYENRREL

SEQ ID NO: 14

MARDYSVGLDIGTSSVGWAAIDNKYHLIRAKSKNLIGVRLFDSAVTAEKRRGYRTTRRRLSRRHWRLRLLNDIFAGPLTDFGD
ENFLARLKYSWVHPQDQSNQAHFAAGLLFDSKEQDKDFYRKYPTIYHLRLALMNDDQKHDLREVYLAIHHLVKYRGHFLIEGD
VKADSAFDVHTFADAIQRYAESNNSDENLLGKIDEKKLSAALTDKHGSKSQRAETAETAFDILDLQSKKQIQAILKSVVGNQA
NLMAIFGLDSSAISKDEQKNYKFSFDDADIDEKIADSEALLSDTEFEFLCDLKAAFDGLTLKMLLGDDKTVSAAMVRRFNEHQ
KDWEYIKSHIRNAKNAGNGLYEKSKKFDGINAAYLALQSDNEDDRKKAKKIFQDEISSADIPDDVKADFLKKIDDDQFLPIQR
TKNNGTIPHQLHRNELEQIIEKQGIYYPFLKDTYQENSHELNKITALINFRVPYYVGPLVEEEQKIADDGKNIPDPTNHWMVR
KSNDTITPWNLSQVVDLDKSGRRFIERLTGTDTYLIGEPTLPKNSLLYQKFDVLQELNNIRVSGRRLDIRAKQDAFEHLFKVQ
KTVSATNLKDFLVQAGYISEDTQIEGLADVNGKNFNNALTTYNYLVSVLGREFVENPSNEELLEEITELQTVFEDKKVLRRQL
DQLDGLSDHNREKLSRKHYTGWGRISKKLLTTKIVQNADKIDNQTFDVPRMNQSIIDTLYNTKMNLMEIINNAEDDFGVRAWI
DKQNTTDGDEQDVYSLIDELAGPKEIKRGIVQSFRILDDITKAVGYAPKRVYLEFARKTQESHLTNSRKNQLSTLLKNAGLSE
LVTQVSQYDAAALQNDRLYLYFLQQGKDMYSGEKLNLDNLSNYDIDHIIPQAYTKDNSLDNRVLVSNITNRRKSDSSNYLPAL
IDKMRPFWSVLSKQGLLSKHKFANLTRTRDFDDMEKERFIARSLVETRQIIKNVASLIDSHFGGETKAVAIRSSLTADMRRYV
DIPKNRDINDYHHAFDALLFSTVGQYTENSGLMKKGQLSDSAGNQYNRYIKEWIHAARLNAQSQRVNPFGFVVGSMRNAAPGK
LNPETGEITPEENADWSIADLDYLHKVMNFRKITVTRRLKDQKGQLYDESRYPSVLHDAKSKASINFDKHKPVDLYGGFSSAK
PAYAALIKFKNKFRLVNVLRQWTYSDKNSEDYILEQIRGKYPKAEMVLSHIPYGQLVKKDGALVTISSATELHNFEQLWLPLA
DYKLINTLLKTKEDNLVDILHNRLDLPEMTIESAFYKAFDSILSFAFNRYALHQNALVKLQAHRDDFNALNYEDKQQTLERIL
DALHASPASSDLKKINLSSGFGRLFSPSHFTLADTDEFIFQSVTGLFSTQKTVAQLYQETK

SEQ ID NO: 15

MVYDVGLDIGTGSVGWVALDENGKLARAKGKNLVGVRLFDTAQTAADRRGFRTTRRRLSRRKWRLRLLDELFSAEINEIDSSF
FQRLKYSYVHPKDEENKAHYYGGYLFPTEEETKKFHRSYPTIYHLRQELMAQPNKRFDIREIYLAIHHLVKYRGHFLSSQEKI
TIGSTYNPEDLANAIEVYADEKGLSWELNNPEQLTEIISGEAGYGLNKSMKADEALKLFEFDNNQDKVAIKTLLAGLTGNQID
FAKLFGKDISDKDEAKLWKLKLDDEALEEKSQTILSQLTDEEIELFHAVVQAYDGFVLIGLLNGADSVSAAMVQLYDQHREDR
KLLKSLAQKAGLKHKRFSEIYEQLALATDEATIKNGISTARELVEESNLSKEVKEDTLRRLDENEFLPKQRTKANSVIPHQLH

-continued

LAELQKILQNQGQYYPFLLDTFEKEDGQDNKIEELLRFRIPYYVGPLVTKKDVEHAGGDADNHWVERNEGFEKSRVTPWNFDK
VFNRDKAARDFIERLTGNDTYLIGEKTLPQNSLRYQLFTVLNELNNVRVNGKKFDSKTKADLINDLFKARKTVSLSALKDYLK
AQGKGDVTITGLADESKFNSSLSSYNDLKKTFDAEYLENEDNQETLEKIIEIQTVFEDSKIASRELSKLPLDDDQVKKLSQTH
YTGWGRLSEKLLDSKIIDERGQKVSILDKLKSTSQNFMSIINNDKYGVQAWITEQNTGSSKLTFDEKVNELTTSPANKRGIKQ
SFAVLNDIKKAMKEEPRRVYLEFAREDQTSVRSVPRYNQLKEKYQSKSLSEEAKVLKKTLDGNKNKMSDDRYFLYFQQQGKDM
YTGRPINFERLSQDYDIDHIIPQAFTKDDSLDNRVLVSRPENARKSDSFAYTDEVQKQDGSLWTSLLKSGFINRKKYERLTKA
GKYLDGQKTGFIARQLVETRQIIKNVASLIEGEYENSKAVAIRSEITADMRLLVGIKKHREINSFHHAFDALLITAAGQYMQN
RYPDRDSTNVYNEFDRYTNDYLKNLRQLSSRDEVRRLKSFGFVVGTMRKGNEDWSEENTSYLRKVMMFKNILTTKKTEKDRGP
LNKETIFSPKSGKKLIPLNSKRSDTALYGGYSNVYSAYMTLVRANGKNLLIKIPISIANQIEVGNLKINDYIVNNPAIKKFEK
ILISKLPLGQLVNEDGNLIYLASNEYRHNAKQLWLSTTDADKIASISENSSDEELLEAYDILTSENVKNRFPFFKKDIDKLSQ
VRDEFLDSDKRIAVIQTILRGLQIDAAYQAPVKIISKKVSDWHKLQQSGGIKLSDNSEMIYQSATGIFETRVKISDLL

SEQ ID NO: 16
IVDYCIGLDLGTGSVGWAVVDMNHRLMKRNGKHLWGSRLFSNAETAANRRASRSIRRRYNKRRERIRLLRAILQDMVLEKDPT
FFIRLEHTSFLDEEDKAKYLGTDYKDNYNLFIDEDFNDYTYYHKYPTIYHLRKALCESTEKADPRLIYLALHHIVKYRGNFLY
EGQKFNMDASNIEDKLSDIFTQFTSFNNIPYEDDEKKNLEILEILKKPLSKKAKVDEVMTLIAPEKDYKSAFKELVTGIAGNK
MNVTKMILCEPIKQGDSEIKLKFSDSNYDDQFSEVEKDLGEYVEFVDALHNVYSWVELQTIMGATHTDNASISEAMVSRYNKH
HDDLKLLKDCIKNNVPNKYFDMFRNDSEKSKGYYNYINRPSKAPVDEFYKYVKKCIEKVDTPEAKQILNDIELENFLLKQNSR
TNGSVPYQMQLDEMIKIIDNQAEYYPILKEKREQLLSILTFRIPYYFGPLNETSEHAWIKRLEGKENQRILPWNYQDIVDVDA
TAEGFIKRMRSYCTYFPDEEVLPKNSLIVSKYEVYNELNKIRVDDKLLEVDVKNDIYNELFMKNKTVTEKKLKNWLVNNQCCS
KDAEIKGFQKENQFSTSLTPWIDFTNIFGKIDQSNFDLIENIIYDLTVFEDKKIMKRRLKKKYALPDDKVKQILKLKYKDWSR
LSKKLLDGIVADNRFGSSVTVLDVLEMSRLNLMEIINDKDLGYAQMIEEATSCPEDGKFTYEEVERLAGSPALKRGIWQSLQI
VEEITKVMKCRPKYIYIEFERSEEAKERTESKIKKLENVYKDLDEQTKKEYKSVLEELKGFDNTKKISSDSLFLYFTQLGKCM
YSGKKLDIDSLDKYQIDHIVPQSLVKDDSFDNRVLVVPSENQRKLDDLVVPFDIRDKMYRFWKLLFDHELISPKKFYSLIKTE
YTERDEERFINRQLVETRQITKNVTQIIEDHYSTTKVAAIRANLSHEFRVKNHIYKNRDINDYHHAHDAYIVALIGGFMRDRY
PNMHDSKAVYSEYMKMFRKNKNDQKRWKDGFVINSMNYPYEVDGKLIWNPDLINEIKKCFYYKDCYCTTKLDQKSGQLFNLTV
LSNDAHADKGVTKAVVPVNKNRSDVHKYGGFSGLQYTIVAIEGQKKKGKKTELVKKISGVPLHLKAASINEKINYIEEKEGLS
DVRIIKDNIPVNQMIEMDGGEYLLTSPTEYVNARQLVLNEKQCALIADIYNAIYKQDYDNLDDILMIQLYIELTNKMKVLYPA
YRGIAEKFESMNENYVVISKEEKANIIKQMLIVMHRGPQNGNIVYDDFKISDRIGRLKTKNHNLNNIVFISQSPTGIYTKKYK
L

SEQ ID NO: 17
MKSEKKYYIGLDVGTNSVGWAVTDEFYNILRAKGKDLWGVRLFEKADTAANTRIFRSGRRRNDRKGMRLQILREIFEDEIKKV
DKDFYDRLDESKFWAEDKKVSGKYSLFNDKNFSDKQYFEKFPTIFHLRKYLMEEHGKVDIRYYFLAINQMMKRRGHFLIDGQI
SHVTDDKPLKEQLILLINDLLKIELEEELMDSIFEILADVNEKRTDKKNNLKELIKGQDFNKQEGNILNSIFESIVTGKAKIK
NIISDEDILEKIKEDNKEDFVLTGDSYEENLQYFEEVLQENITLFNTLKSTYDFLILQSILKGKSTLSDAQVERYDEHKKDLE
ILKKVIKKYDEDGKLFKQVFKEDNGNGYVSYIGYYLNKNKKITAKKKISNIEFTKYVKGILEKQCDCEDEDVKYLLGKIEQEN
FLLKQISSINSVIPHQIHLFELDKILENLAKNYPSFNNKKEEFTKIEKIRKTFTFRIPYYVGPLNDYHKNNGGNAWIFRNKGE
KIRPWNFEKIVDLHKSEEEFIKRMLNQCTYLPEETVLPKSSILYSEYMVLNELNNLRINGKPLDTDVKLKLIEELFKKKTKVT
LKSIRDYMVRNNFADKEDFDNSEKNLEIASNMKSYIDFNNILEDKFDVEMVEDLIEKITIHTGNKKLLKKYIEETYPDLSSSQ
IQKIINLKYKDWGRLSRKLLDGIKGTKKETEKTDTVINFLRNSSDNLMQIIGSQNYSFNEYIDKLRKKYIPQEISYEVVENLY
VSPSVKKMIWQVIRVTEEITKVMGYDPDKIFIEMAKSEEEKKTTISRKNKLLDLYKAIKKDERDSQYEKLLTGLNKLDDSDLR
SRKLYLYYTQMGRDMYTGEKIDLDKLFDSTHYDKDHIIPQSMKKDDSIINNLVLVNKNANQTTKGNIYPVPSSIRNNPKIYNY

-continued

WKYLMEKEFISKEKYNRLIRNTPLTNEELGGFINRQLVETRQSTKAIKELFEKFYQKSKIIPVKASLASDLRKDMNTLKSREV

NDLHHAHDAFLNIVAGDVWNREFTSNPINYVKENREGDKVKYSLSKDFTRPRKSKGKVIWTPEKGRKLIVDTLNKPSVLISNE

SHVKKGELFNATIAGKKDYKKGKIYLPLKKDDRLQDVSKYGGYKAINGAFFFLVEHTKSKKRIRSIELFPLHLLSKFYEDKNT

VLDYAINVLQLQDPKIIIDKINYRTEIIIDNFSYLISTKSNDGSITVKPNEQMYWRVDEISNLKKIENKYKKDAILTEEDRKI

MESYIDKIYQQFKAGKYKNRRTTDTIIEKYEIIDLDTLDNKQLYQLLVAFISLSYKTSNNAVDFTVIGLGTECGKPRITNLPD

NTYLVYKSITGIYEKRIRIK

SEQ ID NO: 18

MKLRGIEDDYSIGLDMGTSSVGWAVTDERGTLAHFKRKPTWGSRLFREAQTAAVARMPRGQRRRYVRRRWRLDLLQKLFEQQM

EQADPDFFIRLRQSRLLRDDRAEEHADYRWPLFNDCKFTERDYYQRFPTIYHVRSWLMETDEQADIRLIYLALHNIVKHRGNF

LREGQSLSAKSARPDEALNHLRETLRVWSSERGFECSIADNGSILAMLTHPDLSPSDRRKKIAPLFDVKSDDAAADKKLGIAL

AGAVIGLKTEFKNIFGDFPCEDSSIYLSNDEAVDAVRSACPDDCAELFDRLCEVYSAYVLQGLLSYAPGQTISANMVEKYRRY

GEDLALLKKLVKIYAPDQYRMFFSGATYPGTGIYDAAQARGYTKYNLGPKKSEYKPSESMQYDDFRKAVEKLFAKTDARADER

YRMMMDRFDKQQFLRRLKTSDNGSIYHQLHLEELKAIVENQGRFYPFLKRDADKLVSLVSFRIPYYVGPLSTRNARTDQHGEN

RFAWSERKPGMQDEPIFPWNWESIIDRSKSAEKFILRMTGMCTYLQQEPVLPKSSLLYEEFCVLNELNGAHWSIDGDDEHRFD

AADREGIIEELFRRKRTVSYGDVAGWMERERNQIGAHVCGGQGEKGFESKLGSYIFFCKDVFKVERLEQSDYPMIERIILWNT

LFEDRKILSQRLKEEYGSRLSAEQIKTICKKRFTGWGRLSEKFLTGITVQVDEDSVSIMDVLREGCPVSGKRGRAMVMMEILR

DEELGFQKKVDDFNRAFFAENAQALGVNELPGSPAVRRSLNQSIRIVDEIASIAGKAPANIFIEVTRDEDPKKKGRRTKRRYN

DLKDALEAFKKEDPELWRELCETAPNDMDERLSLYFMQRGKCLYSGRAIDIHQLSNAGIYEVDHIIPRTYVKDDSLENKALVY

REENQRKTDMLLIDPEIRRRMSGYWRMLHEAKLIGDKKFRNLLRSRIDDKALKGFIARQLVETGQMVKLVRSLLEARYPETNI

ISVKASISHDLRTAAELVKCREANDFHHAHDAFLACRVGLFIQKRHPCVYENPIGLSQVVRNYVRQQADIFKRCRTIPGSSGF

IVNSFMTSGFDKETGEIFKDDWDAEAEVEGIRRSLNFRQCFISRMPFEDHGVFWDATIYSPRAKKTAALPLKQGLNPSRYGSF

SREQFAYFFIYKARNPRKEQTLFEFAQVPVRLSAQIRQDENALERYARELAKDQGLEFIRIERSKILKNQLIEIDGDRLCITG

KEEVRNACELAFAQDEMRVIRMLVSEKPVSRECVISLFNRILLHGDQASRRLSKQLKLALLSEAFSEASDNVQRNVVLGLIAI

FNGSTNMVNLSDIGGSKFAGNVRIKYKKELASPKVNVHLIDQSVTGMFERRTKIGL

SEQ ID NO: 19

MENKQYYIGLDVGTNSVGWAVTDTSYNLLRAKGKDMWGARLFEKANTAAERRTKRTSRRRSEREKARKAMLKELFADEINRVD

PSFFIRLEESKFFLDDRSENNRQRYTLFNDATFTDKDYYEKYKTIFHLRSALINSDEKFDVRLVFLAILNLFSHRGHFLNASL

KGDGDIQGMDVFYNDLVESCEYFEIELPRITNIDNFEKILSQKGKSRTKILEELSEELSISKKDKSYNLIKLISGLEASVVE

LYNIEDIQDENKKIKIGFRESDYEESSLKVKEIIGDEYFDLVERAKSVHDMGLLSNIIGNSKYLCEARVEAYENHHKDLLKIK

ELLKKYDKKAYNDMFRKMTDKNYSAYVGSVNSNIAKERRSVDKRKIEDLYKYIEDTALKNIPDDNKDKIEILEKIKLGEFLKK

QLTASNGVIPNQLQSRELRAILKKAENYLPFLKEKGEKNLTVSEMIIQLFEFQIPYYVGPLDKNPKKDNKANSWAKIKQGGRI

LPWNFEDKVDVKGSRKEFIEKMVRKCTYISDEHTLPKQSLLYEKFMVLNEINNIKIDGEKISVEAKQKIYNDLFVKGKKVSQK

DIKKELISLNIMDKDSVLSGTDTVCNAYLSSIGKFTGVFKEEINKQSIVDMIEDIIFLKTVYGDEKRFVKEEIVEKYGDEIDK

DKIKRILGFKFSNWGNLSKSFLELEGADVGTGEVRSIIQSLWETNFNLMELLSSRFTYMDELEKRVKKLEKPLSEWTIEDLDD

MYLSSPVKRMIWQSMKIVDEIQTVIGYAPKRIFVEMTRSEGEKVRTKSRKDRLKELYNGIKEDSKQWVKELDSKDESYFRSKK

MYLYYLQKGRCMYSGEVIELDKLMDDNLYDIDHIYPRSFVKDDSLDNLVLVKKEINNRKQNDPITPQIQASCQGFWKILHDQG

FMSNEKYSRLTRKTQEFSDEEKLSFINRQIVETGQATKCMAQILQKSMGEDVDVVFSKARLVSEFRHKFELFKSRLINDFHHA

NDAYLNIVVGNSYFVKFTRNPANFIKDARKNPDNPVYKYHMDRFFERDVKSKSEVAWIGQSEGNSGTIVIVKKTMAKNSPLIT

KKVEEGHGSITKETIVGVKEIKFGRNKVEKADKTPKKPNLQAYRPIKTSDERLCNILRYGGRTSISISGYCLVEYVKKRKTIR

SLEAIPVYLGRKDSLSEEKLLNYFRYNLNDGGKDSVSDIRLCLPFISTNSLVKIDGYLYYLGGKNDDRIQLYNAYQLKMKKEE

VEYIRKIEKAVSMSKFDEIDREKNPVLTEEKNIELYNKIQDKFENTVFSKRMSLVKYNKKDLSFGDFLKNKKSKFEEIDLEKQ

CKVLYNIIFNLSNLKEVDLSDIGGSKSTGKCRCKKNITNYKEFKLIQQSITGLYSCEKDLMTI

SEQ ID NO: 20

MKNLKEYYIGLDIGTASVGWAVTDESYNIPKFNGKKMWGVRLFDDAKTAEERRTQRGSRRRLNRRKERINLLQDLFATEISKV
DPNFFLRLDNSDLYREDKDEKLKSKYTLFNDKDFKDRDYHKKYPTIHHLIMDLIEDEGKKDIRLLYLACHYLLKNRGHFIFEG
QKFDTKNSFDKSINDLKIHLRDEYNIDLEFNNEDLIEIITDTTLNKTNKKKELKNIVGDTKFLKAISAIMIGSSQKLVDLFED
GEFEETTVKSVDFSTTAFDDKYSEYEEALGDTISLLNILKSIYDSSILENLLKDADKSKDGNKYISKAFVKKFNKHGKDLKTL
KRIIKKYLPSEYANIFRNKSINDNYVAYTKSNITSNKRTKASKFTKQEDFYKFIKKHLDTIKETKLNSSENEDLKLIDEMLTD
IEFKTFIPKLKSSDNGVIPYQLKLMELKKILDNQSKYYDFLNESDEYGTVKDKVESIMEFRIPYYVGPLNPDSKYAWIKRENT
KITPWNFKDIVDLDSSREEFIDRLIGRCTYLKEEKVLPKASLIYNEFMVLNELNNLKLNEFLITEEMKKAIFEELFKTKKKVT
LKAVSNLLKKEFNLTGDILLSGTDGDFKQGLNSYIDFKNIIGDKVDRDDYRIKIEEIIKLIVLYEDDKTYLKKKIKSAYKNDF
TDDEIKKIAALNYKDWGRLSKRFLTGIEGVDKTTGEKGSIIYFMREYNLNLMELMSGHYTFTEEVEKLNPVENRELCYEMVDE
LYLSPSVKRMLWQSLRVVDEIKRIIGKDPKKIFIEMARAKEAKNSRKESRKNKLLEFYKFGKKAFINEIGEERYNYLLNEINS
EEESKFRWDNLYLYYTQLGRCMYSLEPIDLADLKSNNIYDQDHIYPKSKIYDDSLENRVLVKKNLNHEKGNQYPIPEKVLNKN
AYGFWKILFDKGLIGQKKYTRLTRRTPFEERELAEFIERQIVETRQATKETANLLKNICQDSEIVYSKAENASRFRQEFDIIK
CRTVNDLHHMHDAYLNIVVGNVYNTKFTKNPLNFIKDKDNVRSYNLENMFKYDVVRGSYTAWIADDSEGNVKAATIKKVKREL
EGKNYRFTRMSYIGTGGLYDQNLMRKGKGQIPQKENTNKSNIEKYGGYNKASSAYFALIESDGKAGRERTLETIPIMVYNQEK
YGNTEAVDKYLKDNLELQDPKILKDKIKINSLIKLDGFLYNIKGKTGDSLSIAGSVQLIVNKEEQKLIKKMDKFLVKKKDNKD
IKVTSFDNIKEEELIKLYKTLSDKLNNGIYSNKRNNQAKNISEALDKFKEISIEEKIDVLNQIILLFQSYNNGCNLKSIGLSA
KTGVVFIPKKLNYKECKLINQSITGLFENEVDLLNL

SEQ ID NO: 21

MGKMYYLGLDIGTNSVGYAVTDPSYHLLKFKGEPMWGAHVFAAGNQSAERRSFRTSRRRLDRRQQRVKLVQEIFAPVISPIDP
RFFIRLHESALWRDDVAETDKHIFFNDPTYTDKEYYSDYPTIHHLIVDLMESSEKHDPRLVYLAVAWLVAHRGHFLNEVDKDN
IGDVLSFDAFYPEFLAFLSDNGVSPWVCESKALQATLLSRNSVNDKYKALKSLIFGSQKPEDNFDANISEDGLIQLLAGKKVK
VNKLFPQESNDASFTLNDKEDAIEEILGTLTPDECEWIAHIRRLFDWAIMKHALKDGRTISESKVKLYEQHHHDLTQLKYFVK
TYLAKEYDDIFRNVDSETTKNYVAYSYHVKEVKGTLPKNKATQEEFCKYVLGKVKNIECSEADKVDFDEMIQRLTDNSFMPKQ
VSGENRVIPYQLYYYELKTILNKAASYLPFLTQCGKDAISNQDKLLSIMTFRIPYFVGPLRKDNSEHAWLERKAGKIYPWNFN
DKVDLDKSEEAFIRRMTNTCTYYPGEDVLPLDSLIYEKFMILNEINNIRIDGYPISVDVKQQVFGLFEKKRRVTVKDIQNLLL
SLGALDKHGKLTGIDTTIHSNYNTYHHFKSLMERGVLTRDDVERIVERMTYSDDTKRVRLWLNNNYGTLTADDVKHISRLRKH
DFGRLSKMFLTGLKGVHKETGERASILDFMWNTNDNLMQLLSECYTFSDEITKLQEAYYAKAQLSLNDFLDSMYISNAVKRPI
YRTLAVVNDIRKACGTAPKRIFIEMARDGESKKKRSVTRREQIKNLYRSIRKDFQQEVDFLEKILENKSDGQLQSDALYLYFA
QLGRDMYTGDPIKLEHIKDQSFYNIDHIYPQSMVKDDSLDNKVLVQSEINGEKSSRYPLDAAIRNKMKPLWDAYYNHGLISLK
KYQRLTRSTPFTDDEKWDFINRQLVETRQSTKALAILLKRKFPDTEIVYSKAGLSSDFRHEFGLVKSRNINDLHHAKDAFLAI
VTGNVYHERFNRRWFMVNQPYSVKTKTLFTHSIKNGNFVAWNGEEDLGRIVKMLKQNKNTIHFTRFSFDRKEGLFDIQPLKAS
TGLVPRKAGLDVVKYGGYDKSTAAYYLLVRFTLEDKKTQHKLMMIPVEGLYKARIDHDKEFLTDYAQTTISEILQKDKQKVIN
IMFPMGTRHIKLNSMISIDGFYLSIGGKSSKGKSVLCHAMVPLIVPHKIECYIKAMESFARKFKENNKLRIVEKFDKITVEDN
LNLYELFLQKLQHNPYNKFFSTQFDVLTNGRSTFTKLSPEEQVQTLLNILSIFKTCRSSGCDLKSINGSAQAARIMISADLTG
LSKKYSDIRLVEQSASGLFVSKSQNLLEYL

SEQ ID NO: 22

MTKKEQPYNIGLDIGTSSVGWAVTNDNYDLLNIKKKNLWGVRLFEEAQTAKETRLNRSTRRRYRRRKNRINWLNEIFSEELAK
TDPSFLIRLQNSWVSKKDPDRKRDKYNLFIDGPYTDKEYYREFPTIFHLRKELILNKDKADIRLIYLALHNILKYRGNFTYEH
QKFNISNLNNNLSKELIELNQQLIKYDISFPDDCDWNHISDILIGRGNATQKSSNILKDFTLDKETKKLLKEVINLILGNVAH
LNTIFKTSLTKDEEKLNFSGKDIESKLDDLDSILDDDQFTVLDAANRIYSTITLNEILNGESYFSMAKVNQYENHAIDLCKLR
DMWHTTKNEEAVEQSRQAYDDYINKPKYGTKELYTSLKKFLKVALPTNLAKEAEEKISKGTYLVKPRNSENGVVPYQLNKIEM

-continued

EKIIDNQSQYYPFLKENKEKLLSILSFRIPYYVGPLQSAEKNPFAWMERKSNGHARPWNFDEIVDREKSSNKFIRRMTVTDSY
LVGEPVLPKNSLIYQRYEVLNELNNIRITENLKTNPIGSRLTVETKQRIYNELFKKYKKVTVKKLTKWLIAQGYYKNPILIGL
SQKDEFNSTLTTYLDMKKIFGSSFMEDNKNYDQIEELIEWLTIFEDKQILNEKLHSSKYSYTPDQIKKISNMRYKGWGRLSKK
ILMDITTETNTPQLLQLSNYSILDLMWATNNNFISIMSNDKYDFKNYIENHNLNKNEDQNISDLVNDIHVSPALKRGITQSIK
IVQEIVKFMGHAPKHIFIEVTRETKKSEITTSREKRIKRLQSKLLNKANDFKPQLREYLVPNKKIQEELKKHKNDLSSERIML
YFLQNGKSLYSEESLNINKLSDYQVDHILPRTYIPDDSLENKALVLAKENQRKADDLLLNSNVIDRNLERWTYMLNNNMIGLK
KFKNLTRRVITDKDKLGFIHRQLVQTSQMVKGVANILDNMYKNQGTTCIQARANLSTAFRKALSGQDDTYHFKHPELVKNRNV
NDFHHAQDAYLASFLGTYRLRRFPTNEMLLMNGEYNKFYGQVKELYSKKKKLPDSRKNGFIISPLVNGTTQYDRNTGEIIWNV
GFRDKILKIFNYHQCNVTRKTEIKTGQFYDQTIYSPKNPKYKKLIAQKKDMDPNIYGGFSGDNKSSITIVKIDNNKIKPVAIP
IRLINDLKDKKTLQNWLEENVKHKKSIQIIKNNVPIGQIIYSKKVGLLSLNSDREVANRQQLILPPEHSALLRLLQIPDEDLD
QILAFYDKNILVEILQELITKMKKFYPFYKGEREFLIANIENFNQATTSEKVNSLEELITLLHANSTSAHLIFNNIEKKAFGR
KTHGLTLNNTDFIYQSVTGLYETRIHIE

SEQ ID NO: 23
MTKFNKNYSIGLDIGVSSVGYAVVTEDYRVPAFKFKVLGNTEKEKIKKNLIGSTTFVSAQPAKGTRVFRVNRRRIDRRNHRIT
YLRDIFQKEIEKVDKNFYRRLDESFRVLGDKSEDLQIKQPFFGDKELETAYHKKYPTIYHLRKHLADADKNSPVADIREVYMA
ISHILKYRGHFLTLDKINPNNINMQNSWIDFIESCQEVFDLEISDESKNIADIFKSSENRQEKVKKILPYFQQELLKKDKSIF
KQLLQLLFGLKTKFKDCFELEEEPDLNFSKENYDENLENFLGSLEEDFSDVFAKLKVLRDTILLSGMLTYTGATHARFSATMV
ERYEEHRKDLQRFKFFIKQNLSEQDYLDIFGRKTQNGFDVDKETKGYVGYITNKMVLTNPQKQKTIQQNFYDYISGKITGIEG
AEYFLNKISDGTFLRKLRTSDNGAIPNQIHAYELEKIIERQGKDYPFLLENKDKLLSILTFKIPYYVGPLAKGSNSRFAWIKR
ATSSDILDDNDEDTRNGKIRPWNYQKLINMDETRDAFITNLIGNDIILLNEKVLPKRSLIYEEVMLQNELTRVKYKDKYGKAH
FFDSELRQNIINGLFKNNSKRVNAKSLIKYLSDNHKDLNAIEIVSGVEKGKSFNSTLKTYNDLKTIFSEELLDSEIYQKELEE
IIKVITVFDDKKSIKNYLTKFFGHLEILDEEKINQLSKLRYSGWGRYSAKLLLDIRDEDTGFNLLQFLRNDEENRNLTKLISD
NTLSFEPKIKDIQSKSTIEDDIFDEIKKLAGSPAIKRGILNSIKIVDELVQIIGYPPHNIVIEMARENMTTEEGQKKAKTRKT
KLESALKNIENSLLENGKVPHSDEQLQSEKLYLYYLQNGKDMYTLDKTGSPAPLYLDQLDQYEVDHIIPYSFLPIDSIDNKVL
THRENNQQKLNNIPDKETVANMKPFWEKLYNAKLISQTKYQRLTTSERTPDGVLTESMKAGFIERQLVETRQIIKHVARILDN
RFSDTKIITLKSQLITNFRNTFHIAKIRELNDYHHAHDAYLAVVVGQTLLKVYPKLAPELIYGHHAHFNRHEENKATLRKHLY
SNIMRFFNNPDSKVSKDIWDCNRDLPIIKDVIYNSQINFVKRTMIKKGAFYNQNPVGKFNKQLAANNRYPLKTKALCLDTSIY
GGYGPMNSALSIIIIAERFNEKKGKIETVKEFHDIFIIDYEKFNNNPFQFLNDTSENGFLKKNNINRVLGFYRIPKYSLMQKI
DGTRMLFESKSNLHKATQFKLTKTQNELFFHMKRLLTKSNLMDLKSKSAIKESQNFILKHKEEFDNISNQLSAFSQKMLGNTT
SLKNLIKGYNERKIKEIDIRDETIKYFYDNFIKMFSFVKSGAPKDINDFFDNKCTVARMRPKPDKKLLNATLIHQSITGLYET
RIDLSKLGED

SEQ ID NO: 24
MKQEYFLGLDMGTGSLGWAVTDSTYQVMRKHGKALWGTRLFESASTAEERRMFRTARRRLDRRNWRIQVLQEIFSEEISKVDP
GFFLRMKESKYYPEDKRDAEGNCPELPYALFVDDNYTDKNYHKDYPTIYHLRKMLMETTEIPDIRLVYLVLHHMMKHRGHFLL
SGDISQIKEFKSTFEQLIQNIQDEELEWHISLDDAAIQFVEHVLKDRNLTRSTKKSRLIKQLNAKSACEKAILNLLSGGTVKL
SDIFNNKELDESERPKVSFADSGYDDYIGIVEAELAEQYYIIASAKAVYDWSVLVEILGNSVSISEAKIKVYQKHQADLKTLK
KIVRQYMTKEDYKRVFVDTEEKLNNYSAYIGMTKKNGKKVDLKSKQCTQADFYDFLKKNVIKVIDHKEITQEIESEIEKENFL
PKQVTKDNGVIPYQVHDYELKKILDNLGTRMPFIKENAEKIQQLFEFRIPYYVGPLNRVDDGKDGKFTWSVRKSDARIYPWNF
TEVIDVEASAEKFIRRMTNKCTYLVGEDVLPKDSLVYSKFMVLNELNNLRLNGEKISVELKQRIYEELFCKYRKVTRKKLERY
LVIEGIAKKGVEITGIDGDFKASLTAYHDFKERLTDVQLSQRAKEAIVLNVVLFGDDKKLLKQRLSKMYPNLTTGQLKGICSL
SYQGWGRLSKTFLEEITVPAPGTGEVWNIMTALWQTNDNLMQLLSRNYGFTNEVEEFNTLKKETDLSYKTVDELYVSPAVKRQ

-continued

IWQTLKVVKEIQKVMGNAPKRVFVEMAREKQEGKRSDSRKKQLVELYRACKNEERDWITELNAQSDQQLRSDKLFLYYIQKGR

CMYSGETIQLDELWDNTKYDIDHIYPQSKTMDDSLNNRVLVKKNYNAIKSDTYPLSLDIQKKMMSFWKMLQQQGFITKEKYVR

LVRSDELSADELAGFIERQIVETRQSTKAVATILKEALPDTEIVYVKAGNVSNFRQTYELLKVREMNDLHHAKDAYLNIVVGN

AYFVKFTKNAAWFIRNNPGRSYNLKRMFEFDIERSGEIAWKAGNKGSIVTVKKVMQKNNILVTRKAYEVKGGLFDQQIMKKGK

GQVPIKGNDERLADIEKYGGYNKAAGTYFMLVKSLDKKGKEIRTIEFVPLYLKNQIEINHESAIQYLAQERGLNSPEILLSKI

KIDTLFKVDGFKMWLSGRTGNQLIFKGANQLILSHQEAAILKGVVKYVNRKNENKDAKLSERDGMTEEKLLQLYDTFLDKLSN

TVYSIRLSAQIKTLTEKRAKFIGLSNEDQCIVLNEILHMFQCQSGSANLKLIGGPGSAGILVMNNNITACKQISVINQSPTGI

YEKEIDLIKL

SEQ ID NO: 25

MKKPYSIGLDIGTNSVGWAVVTDDYKVPAKKMKVLGNTDKSHIEKNLLGALLFDSGNTAEDRRLKRTARRRYTRRRNRILYLQ

EIFSEEMGKVDDSFFHRLEDSFLVTEDKRGERHPIFGNLEEEVKYHENFPTIYHLRQYLADNPEKVDLRLVYLALAHIIKFRG

HFLIEGKFDTRNNDVQRLFQEFLAVYDNTFENSSLQEQNVQVEEILTDKISKSAKKDRVLKLFPNEKSNGRFAEFLKLIVGNQ

ADFKKHFELEEKAPLQFSKDTYEEELEVLLAQIGDNYAELFLSAKKLYDSILLSGILTVTDVGTKAPLSASMIQRYNEHQMDL

AQLKQFIRQKLSDKYNEVFSDVSKDGYAGYIDGKTNQEAFYKYLKGLLNKIEGSGYFLDKIEREDFLRKQRTFDNGSIPHQIH

LQEMRAIIRRQAEFYPFLADNQDRIEKLLTFRIPYYVGPLARGKSDFAWLSRKSADKITPWNFDEIVDKESSAEAFINRMTNY

DLYLPNQKVLPKHSLLYEKFTVYNELTKVKYKTEQGKTAFFDANMKQEIFDGVFKVYRKVTKDKLMDFLEKEFDEFRIVDLTG

LDKENKVFNASYGTYHDLCKILDKDFLDNSKNEKILEDIVLTLTLFEDREMIRKRLENYSDLLTKEQVKKLERRHYTGWGRLS

AELIHGIRNKESRKTILDYLIDDGNSNRNFMQLINDDALSFKEEIAKAQVIGETDNLNQVVSDIAGSPAIKKGILQSLKIVDE

LVKIMGHQPENIVVEMARENQFTNQGRRNSQQRLKGLTDSIKEFGSQILKEHPVENSQLQNDRLFLYYLQNGRDMYTGEELDI

DYLSQYDIDHIIPQAFIKDNSIDNRVLTSSKENRGKSDDVPSKDVVRKMKSYWSKLLSAKLITQRKFDNLTKAERGGLTDDDK

AGFIKRQLVETRQITKHVARILDERFNTETDENNKKIRQVKIVTLKSNLVSNFRKEFELYKVREINDYHHAHDAYLNAVIGKA

LLGVYPQLEPEFVYGDYPHFGHKENKATAKKFFYSNIMNFFKKDDVRTDKNGEIIWKKDEHISNIKKVLSYPQVNIVKKVEE

QTGGFSKESILPKGNSDKLIPRKTKKFYWDTKKYGGFDSPIVAYSILVIADIEKGKSKKLKTVKALVGVTIMEKMTFERDPVA

FLERKGYRNVQEENIIKLPKYSLFKLENGRKRLLASARELQKGNEIVLPNHLGTLLYHAKNIHKVDEPKHLDYVDKHKDEFKE

LLDVVSNFSKKYTLAEGNLEKIKELYAQNNGEDLKELASSFINLLTFTAIGAPATFKFFDKNIDRKRYTSTTEILNATLIHQS

ITGLYETRIDLNKLGGD

SEQ ID NO: 26

MDKKYSIGLDIGTNSVGWAVITDEYKVPSKKFKVLGNTDRHSIKKNLIGALLFDSGETAEATRLKRTARRRYTRRKNRICYLQ

EIFSNEMAKVDDSFFHRLEESFLVEEDKKHERHPIFGNIVDEVAYHEKYPTIYHLRKKLVDSTDKADLRLIYLALAHMIKFRG

HFLIEGDLNPDNSDVDKLFIQLVQTYNQLFEENPINASGVDAKAILSARLSKSRRLENLIAQLPGEKKNGLFGNLIALSLGLT

PNFKSNFDLAEDAKLQLSKDTYDDDLDNLLAQIGDQYADLFLAAKNLSDAILLSDILRVNTEITKAPLSASMIKRYDEHHQDL

TLLKALVRQQLPEKYKEIFFDQSKNGYAGYIDGGASQEEFYKFIKPILEKMDGTEELLVKLNREDLLRKQRTFDNGSIPHQIH

LGELHAILRRQEDFYPFLKDNREKIEKILTFRIPYYVGPLARGNSRFAWMTRKSEETITPWNFEEVVDKGASAQSFIERMTNF

DKNLPNEKVLPKHSLLYEYFTVYNELTKVKYVTEGMRKPAFLSGEQKKAIVDLLFKTNRKVTVKQLKEDYFKKIECFDSVEIS

GVEDRFNASLGTYHDLLKIIKDKDFLDNEENEDILEDIVLTLTLFEDREMIEERLKTYAHLFDDKVMKQLKRRRYTGWGRLSR

KLINGIRDKQSGKTILDFLKSDGFANRNFMQLIHDDSLTFKEDIQKAQVSGQGDSLHEHIANLAGSPAIKKGILQTVKVVDEL

VKVMGRHKPENIVIEMARENQTTQKGQKNSRERMKRIEEGIKELGSQILKEHPVENTQLQNEKLYLYYLQNGRDMYVDQELDI

NRLSDYDVDHIVPQSFLKDDSIDNKVLTRSDKNRGKSDNVPSEEVVKKMKNYWRQLLNAKLITQRKFDNLTKAERGGLSELDK

AGFIKRQLVETRQITKHVAQILDSRMNTKYDENDKLIREVKVITLKSKLVSDFRKDFQFYKVREINNYHHAHDAYLNAVVGTA

LIKKYPKLESEFVYGDYKVYDVRKMIAKSEQEIGKATAKYFFYSNIMNFFKTEITLANGEIRKRPLIETNGETGEIVWDKGRD

FATVRKVLSMPQVNIVKKTEVQTGGFSKESILPKRNSDKLIARKKDWDPKKYGGFDSPTVAYSVLVVAKVEKGKSKKLKSVKE

LLGITIMERSSFEKNPIDFLEAKGYKEVKKDLIIKLPKYSLFELENGRKRMLASAGELQKGNELALPSKYVNFLYLASHYEKL

-continued

KGSPEDNEQKQLFVEQHKHYLDEIIEQISEFSKRVILADANLDKVLSAYNKHRDKPIREQAENIIHLFTLTNLGAPAAFKYFD
TTIDRKRYTSTKEVLDATLIHQSITGLYETRIDLSQLGGD

SEQ ID NO: 27

MTKPYSIGLDIGTNSVGWAVTTDNYKVPSKKMKVLGNTSKKYIKKNLLGVLLFDSGITAEGRRLKRTARRRYTRRRNRILYLQ
EIFSTEMATLDDAFFQRLDDSFLVPDDKRDSKYPIFGNLVEEKAYHDEFPTIYHLRKYLADSTKKADLRLVYLALAHMIKYRG
HFLIEGEFNSKNNDIQKNFQDFLDTYNAIFESDLSLENSKQLEEIVKDKISKLEKKDRILKLFPGEKNSGIFSEFLKLIVGNQ
ADFRKCFNLDEKASLHFSKESYDEDLETLLGYIGDDYSDVFLKAKKLYDAILLSGFLTVTDNETEAPLSSAMIKRYNEHKEDL
ALLKEYIRNISLKTYNEVFKDDTKNGYAGYIDGKTNQEDFYVYLKKLLAEFEGADYFLEKIDREDFLRKQRTFDNGSIPYQIH
LQEMRAILDKQAKFYPFLAKNKERIEKILTFRIPYYVGPLARGNSDFAWSIRKRNEKITPWNFEDVIDKESSAEAFINRMTSF
DLYLPEEKVLPKHSLLYETFNVYNELTKVRFIAESMRDYQFLDSKQKKDIVRLYFKDKRKVTDKDIIEYLHAIYGYDGIELKG
IEKQFNSSLSTYHDLLNIINDKEFLDDSSNEAIIEEIIHTLTIFEDREMIKQRLSKFENIFDKSVLKKLSRRHYTGWGKLSAK
LINGIRDEKSGNTILDYLIDDGISNRNFMQLIHDDALSFKKKIQKAQIIGDEDKGNIKEVVKSLPGSPAIKKGILQSIKIVDE
LVKVMGGRKPESIVVEMARENQYTNQGKSNSQQRLKRLEKSLKELGSKILKENIPAKLSKIDNNALQNDRLYLYYLQNGKDMY
TGDDLDIDRLSNYDIDHIIPQAFLKDNSIDNKVLVSSASNRGKSDDVPSLEVVKKRKTFWYQLLKSKLISQRKFDNLTKAERG
GLSPEDKAGFIQRQLVETRQITKHVARLLDEKFNNKKDENNRAVRTVKIITLKSTLVSQFRKDFELYKVREINDFHHAHDAYL
NAVVASALLKKYPKLEPEFVYGDYPKYNSFRERKSATEKVYFYSNIMNIFKKSISLADGRVIERPLIEVNEETGESVWNKESD
LATVRRVLSYPQVNVVKKVEEQNHGLDRGKPKGLFNANLSSKPKPNSNENLVGAKEYLDPKKYGGYAGISNSFTVLVKGTIEK
GAKKKITNVLEFQGISILDRINYRKDKLNFLLEKGYKDIELIIELPKYSLFELSDGSRRMLASILSTNNKRGEIHKGNQIFLS
QKFVKLLYHAKRISNTINENHRKYVENHKKEFEELFYYILEFNENYVGAKKNGKLLNSAFQWSWQNHSIDELCSSFIGPTGSER
KGLFELTSRGSAADFEFLGVKIPRYRDYTPSSLLKDATLIHQSVTGLYETRIDLAKLGEG

SEQ ID NO: 28

MKKQKFSDYYLGFDIGTNSVGWCVTDLDYNVLRFNKKDMWGSRLFDEAKTAAERRVQRNSRRRLKRRKWRLNLLEEIFSDEIM
KIDSNFFRRLKESSLWLEDKNSKEKFTLFNDDNYKDYDFYKQYPTIFHLRDELIKNPEKKDIRLIYLALHSIFKSRGHFLFEG
QNLKEIKNFETLYNNLISFLEDNGINKSIDKDNIEKLEKIICDSGKGLKDKEKEFKGIFNSDKQLVAIFKLSVGSSVSLNDLF
DTDEYKKEEVEKEKISFREQIYEDDKPIYYSILGEKIELLDIAKSFYDFMVLNNILSDSNYISEAKVKLYEEHKKDLKNLKYI
IRKYNKENYDKLFKDKNENNYPAYIGLNKEKDKKEVVEKSRLKIDDLIKVIKGYLPKPERIEEKDKTIFNEILNKIELKTILP
KQRISDNGTLPYQIHEVELEKILENQSKYYDFLNYEENGVSTKDKLLKTFKFRIPYYVGPLNSYHKDKGGNSWIVRKEEGKIL
PWNFEQKVDIEKSAEEFIKRMTNKCTYLNGEDVIPKDSFLYSEYIILNELNKVQVNDEFLNEENKRKIIDELFKENKKVSEKK
FKEYLLVNQIANRTVELKGIKDSFNSNYVSYIKFKDIFGEKLNLDIYKEISEKSILWKCLYGDDKKIFEKKIKNEYGDILNKD
EIKKINSFKFNTWGRLSEKLLTGIEFINLETGECYSSVMEALRRTNYNLMELLSSKFTLQESIDNENKEMNEVSYRDLIEESY
VSPSLKRAILQTLKIYEEIKKITGRVPKKVFIEMARGGDESMKNKKIPARQEQLKKLYDSCGNDIANFSIDIKEMKNSLSSYD
NNSLRQKKLYLYYLQFGKCMYTGREIDLDRLLQNNDTYDIDHIYPRSKVIKDDSFDNLVLVLKNENAEKSNEYPVKKEIQEKM
KSFWRFLKEKNFISDEKYKRLTGKDDFELRGFMARQLVNVRQTTKEVGKILQQIEPEIKIVYSKAEIASSFREMFDFIKVREL
NDTHHAKDAYLNIVAGNVYNTKFTEKPYRYLQEIKENYDVKKIYNYDIKNAWDKENSLEIVKKNMEKNTVNITRFIKEEKGEL
FNLNPIKKGETSNEIISIKPKLYDGKDNKLNEKYGYYTSLKAAYFIYVEHEKKNKKVKTFERITRIDSTLIKNEKNLIKYLVS
QKKLLNPKIIKKIYKEQTLIIDSYPYTFTGVDSNKKVELKNKKQLYLEKKYEQILKNALKFVEDNQGETEENYKFIYLKKRNN
NEKNETIDAVKERYNIEFNEMYDKFLEKLSSKDYKNYINNKLYTNFLNSKEKFKKLKLWEKSLILREFLKIFNKNTYGKYEIK
DSQTKEKLFSFPEDTGRIRLGQSSLGNNKELLEESVTGLFVKKIKL

SEQ ID NO: 29

MKNYTIGLDIGVASVGWVCIDENYKILNYNNRHAFGVHEFESAESAAGRRLKRGMRRRYNRRKKRLQLLQSLFDSYITDSGFF
SKTDSQHFWKNNNEFENRSLTEVLSSLRISSRKYPTIYHLRSDLIESNKKMDLRLVYLALHNLVKYRGHFLQEGNWSEAASAE
GMDDQLLELVTRYAELENLSPLDLSESQWKAAETLLLNRNLTKTDQSKELTAMFGKEYEPFCKLVAGLGVSLHQLFPSSEQAL

-continued

AYKETKTKVQLSNENVEEVMELLLEEESALLEAVQPFYQQVVLYELLKGETYVAKAKVSAFKQYQKDMASLKNLLDKTFGEKV

YRSYFISDKNSQREYQKSHKVEVLCKLDQFNKEAKFAETFYKDLKKLLEDKSKTSIGTTEKDEMLRIIKAIDSNQFLQKQKGI

QNAAIPHQNSLYEAEKILRNQQAHYPFITTEWIEKVKQILAFRIPYYIGPLVKDTTQSPFSWVERKGDAPITPWNFDEQIDKA

ASAEAFISRMRKTCTYLKGQEVLPKSSLTYERFEVLNELNGIQLRTTGAESDFRHRLSYEMKCWIIDNVFKQYKTVSTKRLLQ

ELKKSPYADELYDEHTGEIKEVFGTQKENAFATSLSGYISMKSILGAVVDDNPAMTEELIYWIAVFEDREILHLKIQEKYPSI

TDVQRQKLALVKLPGWGRFSRLLIDGLPLDEQGQSVLDHMEQYSSVFMEVLKNKGFGLEKKIQKMNQHQVDGTKKIRYEDIEE

LAGSPALKRGIWRSVKIVEELVSIFGEPANIVLEVAREDGEKKRTKSRKDQWEELTKTTLKNDPDLKSFIGEIKSQGDQRFNE

QRFWLYVTQQGKCLYTGKALDIQNLSMYEVDHILPQNFVKDDSLDNLALVMPEANQRKNQVGQNKMPLEIIEANQQYAMRTLW

ERLHELKLISSGKLGRLKKPSFDEVDKDKFIARQLVETRQIIKHVRDLLDERFSKSDIHLVKAGIVSKFRRFSEIPKIRDYNN

KHHAMDALFAAALIQSILGKYGKNFLAFDLSKKDRQKQWRSVKGSNKEFFLFKNFGNLRLQSPVTGEEVSGVEYMKHVYFELP

WQTTKMTQTGDGMFYKESIFSPKVKQAKYVSPKTEKFVHDEVKNHSICLVEFTFMKKEKEVQETKFIDLKVIEHHQFLKEPES

QLAKFLAEKETNSPIIHARIIRTIPKYQKIWIEHFPYYFISTRELHNARQFEISYELMEKVKQLSERSSVEELKIVFGLLIDQ

MNDNYPIYTKSSIQDRVQKFVDTQLYDFKSFEIGFEELKKAVAANAQRSDTFGSRISKKPKPEEVAIGYESITGLKYRKPRSV

VGTKR

SEQ ID NO: 30

MKKEIKDYFLGLDVGTGSVGWAVTDTDYKLLKANRKDLWGMRCFETAETAEVRRLHRGARRRIERRKKRIKLLQELFSQEIAK

TDEGFFQRMKESPFYAEDKTILQENTLFNDKDFADKTYHKAYPTINHLIKAWIENKVKPDPRLLYLACHNIIKKRGHFLFEGD

FDSENQFDTSIQALFEYLREDMEVDIDADSQKVKEILKDSSLKNSEKQSRLNKILGLKPSDKQKKAITNLISGNKINFADLYD

NPDLKDAEKNSISFSKDDFDALSDDLASILGDSFELLLKAKAVYNCSVLSKVIGDEQYLSFAKVKIYEKHKTDLTKLKNVIKK

HFPKDYKKVFGYNKNEKNNNNYSGYVGVCKTKSKKLIINNSVNQEDFYKFLKTILSAKSEIKEVNDILTEIETGTFLPKQISK

SNAEIPYQLRKMELEKILSNAEKHFSFLKQKDEKGLSHSEKIIMLLTFKIPYYIGPINDNHKKFFPDRCWVVKKEKSPSGKTT

PWNFFDHIDKEKTAEAFITSRTNFCTYLVGESVLPKSSLLYSEYTVLNEINNLQIIIDGKNICDIKLKQKIYEDLFKKYKKIT

QKQISTFIKHEGICNKTDEVIILGIDKECTSSLKSYIELKNIFGKQVDEISTKNMLEEIIRWATIYDEGEGKTILKTKIKAEY

GKYCSDEQIKKILNLKFSGWGRLSRKFLETVTSEMPGFSEPVNIITAMRETQNNLMELLSSEFTFTENIKKINSGFEDAEKQF

SYDGLVKPLFLSPSVKKMLWQTLKLVKEISHITQAPPKKIFIEMAKGAELEPARTKTRLKILQDLYNNCKNDADAFSSEIKDL

SGKIENEDNLRLRSDKLYLYYTQLGKCMYCGKPIEIGHVFDTSNYDIDHIYPQSKIKDDSISNRVLVCSSCNKNKEDKYPLKS

EIQSKQRGFWNFLQRNNFISLEKLNRLTRATPISDDETAKFIARQLVETRQATKVAAKVLEKMFPETKIVYSKAETVSMFRNK

FDIVKCREINDFHHAHDAYLNIVVGNVYNTKFTNNPWNFIKEKRDNPKIADTYNYYKVFDYDVKRNNITAWEKGKTIITVKDM

LKRNTPIYTRQAACKKGELFNQTIMKKGLGQHPLKKEGPFSNISKYGGYNKVSAAYYTLIEYEEKGNKIRSLETIPLYLVKDI

QKDQDVLKSYLTDLLGKKEFKILVPKIKINSLLKINGFPCHITGKTNDSFLLRPAVQFCCSNNEVLYFKKIIRFSEIRSQREK

IGKTISPYEDLSFRSYIKENLWKKTKNDEIGEKEFYDLLQKKNLEIYDMLLTKHKDTIYKKRPNSATIDILVKGKEKFKSLII

ENQFEVILEILKLFSATRNVSDLQHIGGSKYSGVAKIGNKISSLDNCILIYQSITGIFEKRIDLLKV

SEQ ID NO: 31

MEGQMKNNGNNLQQGNYYLGLDVGTSSVGWAVTDTDYNVLKFRGKSMWGARLFDEASTAEEERRTHRGNRRRLARRKYRLLLLE

QLFEKEIRKIDDNFFVRLHESNLWADDKSKPSKFLLFNDTNFTDKDYLKKYPTIYHLRSDLIHNSTEHDIRLVFLALHHLIKY

RGHFIYDNSANGDVKTLDEAVSDFEEYLNENDIEFNIENKKEFINVLSDKHLTKKEKKISLKKLYGDITDSENINISVLIEML

SGSSISLSNLFKDIEFDGKQNLSLDSDIEETLNDVVDILGDNIDLLIHAKEVYDIAVLTSSLGKHKYLCDAKVELFEKNKKDL

MILKKYIKKNHPEDYKKIFSSPTEKKNYAAYSQTNSKNVCSQEEFCLFIKPYIRDMVKSENEDEVRIAKEVEDKSFLTKLKGT

NNSVVPYQIHERELNQILKNIVAYLPFMNDEQEDISVVDKIKLIFKFKIPYYVGPLNTKSTRSWVYRSDEKIYPWNFSNVIDL

DKTAHEFMNRLIGRCTYTNDPVLPMDSLLYSKYNVLNEINPIKVNGKAIPVEVKQAIYTDLFENSKKKVTRKSIYIYLLKNGY

IEKEDIVSGIDIEIKSKLKSHHDFTQIVQENKCTPEEIERIIKGILVYSDDKSMLRRWLKNNIKGLSENDVKYLAKLNYKEWG

-continued

RLSKTLLTDIYTINPEDGEACSILDIMWNTNATLMEILSNEKYQFKQNIENYKAENYDEKQNLHEELDDMYISPAARRSIWQA
LRIVDEIVDIKKSAPKKIFIEMAREKKSAMKKKRTESRKDTLLELYKSCKSQADGFYDEELFEKLSNESNSRLRRDQLYLYYT
QMGRSMYTGKRIDFDKLINDKNTYDIDHIYPRSKIKDDSITNRVLVEKDINGEKTDIYPISEDIRQKMQPFWKILKEKGLINE
EKYKRLTRNYELTDEELSSFVARQLVETQQSTKALATLLKKEYPSAKIVYSKAGNVSEFRNRKDKELPKFREINDLHHAKDAY
LNIVVGNVYDTKFTEKFFNNIRNENYSLKRVFDFSVPGAWDAKGSTFNTIKKYMAKNNPIIAFAPYEVKGELFDQQIVPKGKG
QFPIKQGKDIEKYGGYNKLSSAFLFAVEYKGKKARERSLETVYIKDVELYLQDPIKYCESVLGLKEPQIIKPKILMGSLFSIN
NKKLVVTGRSGKQYVCHHIYQLSINDEDSQYLKNIAKYLQEEPDGNIERQNILNITSVNNIKLFDVLCTKFNSNTYEIILNSL
KNDVNEGREKFSELDILEQCNILLQLLKAFKCNRESSNLEKLNNKKQAGVIVIPHLFTKCSVFKVIHQSITGLFEKEMDLLK

SEQ ID NO: 32

MGRKPYILSLDIGTGSVGYACMDKGFNVLKYHDKDALGVYLFDGALTAQERRQFRTSRRRKNRRIKRLGLLQELLAPLVQNPN
FYQFQRQFAWKNDNMDFKNKSLSEVLSFLGYESKKYPTIYHLQEALLLKDEKFDPELIYMALYHLVKYRGHFLFDHLKIENLT
NNDNMHDFVELIETYENLNNIKLNLDYEKTKVIYEILKDNEMTKNDRAKRVKNMEKKLEQFSIMLLGLKFNEGKLFNHADNAE
ELKGANQSHTFADNYEENLTPFLTVEQSEFIERANKIYLSLTLQDILKGKKSMAMSKVAAYDKFRNELKQVKDIVYKADSTRT
QFKKIFVSSKKSLKQYDATPNDQTFSSLCLFDQYLIRPKKQYSLLIKELKKIIPQDSELYFEAENDTLLKVLNTTDNASIPMQ
INLYEAETILRNQQKYHAEITDEMIEKVLSLIQFRIPYYVGPLVNDHTASKFGWMERKSNESIKPWNFDEVVDRSKSATQFIR
RMTNKCSYLINEDVLPKNSLLYQEMEVLNELNATQIRLQTDPKNRKYRMMPQIKLFAVEHIFKKYKTVSHSKFLEIMLNSNHR
ENFMNHGEKLSIFGTQDDKKFASKLSSYQDMTKIFGDIEGKRAQIEEIIQWITIFEDKKILVQKLKECYPELTSKQINQLKKL
NYSGWGRLSEKLLTHAYQGHSIIELLRHSDENFMEILTNDVYGFQNFIKEENQVQSNKIQHQDIANLTTSPALKKGIWSTIKL
VRELTSIFGEPEKIIMEFATEDQQKGKQKSRKQLWDDNIKKNLKSVDEYKYIIDVANKLNNEQLQQEKLWLYLSQNGKCMY
SGQSIDLDALLSPNATKHYEVDHIFPRSFIKDDSIDNKVLVIKKMNQTKGDQVPLQFIQQPYERIAYWKSLNKAGLISDSKLH
KLMKPEFTAMDKEGFIQRQLVETRQISVHVRDFLKEEYPNTKVIPMKAKMVSEFRKKFDIPKIRQMNDAHHAIDAYLNGVVYH
GAQLAYPNVDLFDFNFKWEKVREKWKALGEFNTKQKSRELFFFKKLEKMEVSQGERLISKIKLDMNHFKINYSRKLANIPQQF
YNQTAVSPKTAELKYESNKSNEVVYKGLTPYQTYVVAIKSVNKKGKEKMEYQMIDHYVFDFYKFQNGNEKELALYLAQRENKD
EVLDAQIVYSLNKGDLLYINNHPCYFVSRKEVINAKQFELTVEQQLSLYNVMNNKETNVEKLLIEYDFIAEKVINEYHHYLNS
KLKEKRVRTFFSESNQTHEDFIKALDELFKVVTASATRSDKIGSRKNSMTHRAFLGKGKDVKIAYTSISGLKTTKPKSLFKLA
ESRNEL

SEQ ID NO: 33

MAKILGLDLGTNSIGWAVVERENIDFSLIDKGVRIFSEGVKSEKGIESSRAAERTGYRSARKIKYRRKLRKYETLKVLSLNRM
CPLSIEEVEEWKKSGFKDYPLNPEFLKWLSTDEESNVNPYFFRDRASKHKVSLFELGRAFYHIAQRRGFLSNRLDQSAEGILE
EHCPKIEAIVEDLISIDEISTNITDYFFETGILDSNEKNGYAKDLDEGDKKLVSLYKSLLAILKKNESDFENCKSEIIERLNK
KDVLGKVKGKIKDISQAMLDGNYKTLGQYFYSLYSKEKIRNQYTSREEHYLSEFITICKVQGIDQINEEEKINEKKFDGLAKD
LYKAIFFQRPLKSQKGLIGKCSFEKSKSRCAISHPDFEEYRMWTYLNTIKIGTQSDKKLRFLTQDEKLKLVPKFYRKNDFNFD
VLAKELIEKGSSFGFYKSSKKNDFFYWFNYKPTDTVAACQVAASLKNAIGEDWKTKSFKYQTINSNKEQVSRTVDYKDLWHLL
TVATSDVYLYEFAIDKLGLDEKNAKAFSKTKLKKDFASLSLSAINKILPYLKEGLLYSHAVFVANIENIVDENIWKDEKQRDY
IKTQISEIIENYTLEKSRFEIINGLLKEYKSENEDGKRVYYSKEAEQSFENDLKKKLVLFYKSNEIENKEQQETIFNELLPIF
IQQLKDYEFIKIQRLDQKVLIFLKGKNETGQIFCTEEKGTAEEKEKKIKNRLKKLYHPSDIEKFKKKIIKDEFGNEKIVLGSP
LTPSIKNPMAMRALHQLRKVLNALILEGQIDEKTIIHIEMARELNDANKRKGIQDYQNDNKKFREDAIKEIKKLYFEDCKKEV
EPTEDDILRYQLWMEQNRSEIYEEGKNISICDIIGSNPAYDIEHTIPRSRSQDNSQMNKTLCSQRFNREVKKQSMPIELNNHL
EILPRIAHWKEEADNLTREIEIISRSIKAAATKEIKDKKIRRRHYLTLKRDYLQGKYDRFIWEEPKVGFKNSQIPDTGIITKY
AQAYLKSYFKKVESVKGGMVAEFRKIWGIQESFIDENGMKHYKVKDRSKHTHHTIDAITIACMTKEKYDVLAHAWTLEDQQNK
KEARSIIEASKPWKTFKEDLLKIEEEILVSHYTPDNVKKQAKKIVRVRGKKQFVAEVERDVNGKAVPKKAASGKTIYKLDGEG
KKLPRLQQGDTIRGSLHQDSIYGAIKNPLNTDEIKYVIRKDLESIKGSDVESIVDEVVKEKIKEAIANKVLLLSSNAQQKNKL

-continued

VGTVWMNEEKRIAINKVRIYANSVKNPLHIKEHSLLSKSKHVHKQKVYGQNDENYAMAIYELDGKRDFELINIFNLAKLIKQG

QGFYPLHKKKEIKGKIVFVPIEKRNKRDVVLKRGQQVVFYDKEVENPKDISEIVDFKGRIYIIEGLSIQRIVRPSGKVDEYGV

IMLRYFKEARKADDIKQDNFKPDGVFKLGENKPTRKMNHQFTAFVEGIDFKVLPSGKFEKI

SEQ ID NO: 34

MEFKKVLGLDIGTNSIGCALLSLPKSIQDYGKGGRLEWLTSRVIPLDADYMKAFIDGKNGLPQVITPAGKRRQKRGSRRLKHR

YKLRRSRLIRVFKTLNWLPEDFPLDNPKRIKETISTEGKFSFRISDYVPISDESYREFYREFGYPENEIEQVIEEINFRRKTK

GKNKNPMIKLLPEDWVVYLRKKALIKPTTKEELIRIIYLFNQRRGFKSSRKDLTETAILDYDEFAKRLAEKEKYSAENYETK

FVSITKVKEVVELKTDGRKGKKRFKVILEDSRIEPYEIERKEKPDWEGKEYTFLVTQKLEKGKFKQNKPDLPKEEDWALCTTA

LDNRMGSKHPGEFFFDELLKAFKEKRGYKIRQYPVNRWRYKKELEFIWTKQCQLNPELNNLNINKEILRKLATVLYPSQSKFF

GPKIKEFENSDVLHIISEDIIYYQRDLKSQKSLISECRYEKRKGIDGEIYGLKCIPKSSPLYQEFRIWQDIHNIKVIRKESEV

NGKKKINIDETQLYINENIKEKLFELFNSKDSLSEKDILELISLNIINSGIKISKKEEETTHRINLFANRKELKGNETKSRYR

KVFKKLGFDGEYILNHPSKLNRLWHSDYSNDYADKEKTEKSILSSLGWKNRNGKWEKSKNYDVFNLPLEVAKAIANLPPLKKE

YGSYSALAIRKMLVVMRDGKYWQHPDQIAKDQENTSLMLFDKNLIQLTNNQRKVLNKYLLTLAEVQKRSTLIKQKLNEIEHNP

YKLELVSDQDLEKQVLKSFLEKKNESDYLKGLKTYQAGYLIYGKHSEKDVPIVNSPDELGEYIRKKLPNNSLRNPIVEQVIRE

TIFIVRDVWKSFGIIDEIHIELGRELKNNSEERKKTSESQEKNFQEKERARKLLKELLNSSNFEHYDENGNKIFSSFTVNPNP

DSPLDIEKFRIWKNQSGLTDEELNKKLKDEKIPTEIEVKKYILWLTQKCRSPYTGKIIPLSKLFDSNVYEIEHIIPRSKMKND

STNNLVICELGVNKAKGDRLAANFISESNGKCKFGEVEYTLLKYGDYLQYCKDTFKYQKAKYKNLLATEPPEDFIERQINDTR

YIGRKLAELLTPVVKDSKNIIFTIGSITSELKITWGLNGVWKDILRPRFKRLESIINKKLIFQDEDDPNKYHFDLSINPQLDK

EGLKRLDHRHHALDATIIAATTREHVRYLNSLNAADNDEEKREYFLSLCNHKIRDFKLPWENFTSEVKSKLLSCVVSYKESKP

ILSDPFNKYLKWEYKNGKWQKVFAIQIKNDRWKAVRRSMFKEPIGTVWIKKIKEVSLKEAIKIQAIWEEVKNDPVRKKKEKYI

YDDYAQKVIAKIVQELGLSSSMRKQDDEKLNKFINEAKVSAGVNKNLNTTNKTIYNLEGRFYEKIKVAEYVLYKAKRMPLNKK

EYIEKLSLQKMFNDLPNFILEKSILDNYPEILKELESDNKYIIEPHKKNNPVNRLLLEHILEYHNNPKEAFSTEGLEKLNKKA

INKIGKPIKYITRLDGDINEEEIFRGAVFETDKGSNVYFVMYENNQTKDREFLKPNPSISVLKAIEHKNKIDFFAPNRLGFSR

IILSPGDLVYVPTNDQYVLIKDNSSNETIINWDDNEFISNRIYQVKKFTGNSCYFLKNDIASLILSYSASNGVGEFGSQNISE

YSVDDPPIRIKDVCIKIRVDRLGNVRPL

SEQ ID NO: 35

MKHILGLDLGTNSIGWALIERNIEEKYGKIIGMGSRIVPMGAELSKFEQGQAQTKNADRRTNRGARRLNKRYKQRRNKLIYIL

QKLDMLPSQIKLKEDFSDPNKIDKITILPISKKQEQLTAFDLVSLRVKALTEKVGLEDLGKIIYKYNQLRGYAGGSLEPEKED

IFDEEQSKDKKNKSFIAFSKIVFLGEPQEEIFKNKKLNRRAIIVETEEGNFEGSTFLENIKVGDSLELLINISASKSGDTITI

KLPNKTNWRKKMENIENQLKEKSKEMGREFYISEFLLELLKENRWAKIRNNTILRARYESEFEAIWNEQVKHYPFLENLDKKT

LIEIVSFIFPGEKESQKKYRELGLEKGLKYIIKNQVVFYQRELKDQSHLISDCRYEPNEKAIAKSHPVFQEYKVWEQINKLIV

NTKIEAGTNRKGEKKYKYIDRPIPTALKEWIFEELQNKKEITFSAIFKKLKAEFDLREGIDFLNGMSPKDKLKGNETKLQLQK

SLGELWDVLGLDSINRQIELWNILYNEKGNEYDLTSDRTSKVLEFINKYGNNIVDDNAEETAIRISKIKFARAYSSLSLKAVE

RILPLVRAGKYFNNDFSQQLQSKILKLLNENVEDPFAKAAQTYLDNNQSVLSEGGVGNSIATILVYDKHTAKEYSHDELYKSY

KEINLLKQGDLRNPLVEQIINEALVLIRDIWKNYGIKPNEIRVELARDLKNSAKERATIHKRNKDNQTINNKIKETLVKNKKE

LSLANIEKVKLWEAQRHLSPYTGQPIPLSDLFDKEKYDVDHIIPISRYFDDSFTNKVISEKSVNQEKANRTAMEYFEVGSLKY

SIFTKEQFIAHVNEYFSGVKRKNLLATSIPEDPVQRQIKDTQYIAIRVKEELNKIVGNENVKTTTGSITDYLRNHWGLTDKFK

LLLKERYEALLESEKFLEAEYDNYKKDFDSRKKEYEEKEVLFEEQELTREEFIKEYKENYIRYKKNKLIIKGWSKRIDHRHHA

IDALIVACTEPAHIKRLNDLNKVLQDWLVEHKSEFMPNFEGSNSELLEEILSLPENERTEIFTQIEKFRAIEMPWKGFPEQVE

QKLKEIIISHKPKDKLLLQYNKAGDRQIKLRGQLHEGTLYGISQGKEAYRIPLTKFGGSKFATEKNIQKIVSPFLSGFIANHL

KEYNNKKEEAFSAEGIMDLNNKLAQYRNEKGELKPHTPISTVKIYYKDPSKNKKKKDEEDLSLQKLDREKAFNEKLYVKTGDN

-continued

YLFAVLEGEIKTKKTSQIKRLYDIISFFDATNFLKEEFRNAPDKKTFDKDLLFRQYFEERNKAKLLFTLKQGDFVYLPNENEE

VILDKESPLYNQYWGDLKERGKNIYVVQKFSKKQIYFIKHTIADIIKKDVEFGSQNCYETVEGRSIKENCFKLEIDRLGNIVK

VIKR

SEQ ID NO: 36

MHVEIDFPHFSRGDSHLAMNKNEILRGSSVLYRLGLDLGSNSLGWFVTHLEKRGDRHEPVALGPGGVRIFPDGRDPQSGTSNA

VDRRMARGARKRRDRFVERRKELIAALIKYNLLPDDARERRALEVLDPYALRKTALTDTLPAHHVGRALFHLNQRRGFQSNRK

TDSKQSEDGAIKQAASRLATDKGNETLGVFFADMHLRKSYEDRQTAIRAELVRLGKDHLTGNARKKIWAKVRKRLFGDEVLPR

ADAPHGVRARATITGTKASYDYYPTRDMLRDEFNAIWAGQSAHHATITDEARTEIEHIIFYQRPLKPAIVGKCTLDPATRPFK

EDPEGYRAPWSHPLAQRFRILSEARNLEIRDTGKGSRRLTKEQSDLVVAALLANREVKFDKLRTLLKLPAEARFNLESDRRAA

LDGDQTAARLSDKKGFNKAWRGFPPERQIAIVARLEETEDENELIAWLEKECALDGAAAARVANTTLPDGHCRLGLRAIKKIV

PIMQDGLDEDGVAGAGYHIAAKRAGYDHAKLPTGEQLGRLPYYGQWLQDAVVGSGDARDQKEKQYGQFPNPTVHIGLGQLRRV

VNDLIDKYGPPTEISIEFTRALKLSEQQKAERQREQRRNQDKNKARAEELAKFGRPANPRNLLKMRLWEELAHDPLDRKCVYT

GEQISIERLLSDEVDIDHILPVAMTLDDSPANKIICMRYANRHKRKQTPSEAFGSSPTLQGHRYNWDDIAARATGLPRNKRWR

FDANAREEFDKRGGFLARQLNETGWLARLAKQYLGAVTDPNQIWVVPGRLTSMLRGKWGLNGLLPSDNYAGVQDKAEEFLAST

DDMEFSGVKNRADHRHHAIDGLVTALTDRSLLWKMANAYDEEHEKFVIEPPWPTMRDDLKAALEKMVVSHKPDHGIEGKLHED

SAYGFVKPLDATGLKEEEAGNLVYRKAIESLNENEVDRIRDIQLRTIVRDHVNVEKTKGVALADALRQLQAPSDDYPQFKHGL

RHVRILKKEKGDYLVPIANRASGVAYKAYSAGENFCVEVFETAGGKWDGEAVRRFDANKKNAGPKIAHAPQWRDANEGAKLVM

RIHKGDLIRLDHEGRARIMVVHRLDAAAGRFKLADHNETGNLDKRHATNNDIDPFRWLMASYNTLKKLAAVPVRVDELGRVWR

VMPN

SEQ ID NO: 37

METTLGIDLGTNSIGLALVDQEEHQILYSGVRIFPEGINKDTIGLGEKEESRNATRRAKRQMRRQYFRKKLRKAKLLELLIAY

DMCPLKPEDVRRWKNWDKQQKSTVRQFPDTPAFREWLKQNPYELRKQAVTEDVTRPELGRILYQMIQRRGFLSSRKGKEEGKI

FTGKDRMVGIDETRKNLQKQTLGAYLYDIAPKNGEKYRFRTERVRARYTLRDMYIREFEIIWQRQAGHLGLAHEQATRKKNIF

LEGSATNVRNSKLITHLQAKYGRGHVLIEDTRITVTFQLPLKEVLGGKIEIEEEQLKFKSNESVLFWQRPLRSQKSLLSKCVF

EGRNFYDPVHQKWIIAGPTPAPLSHPEFEEFRAYQFINNIIYGKNEHLTAIQREAVFELMCTESKDFNFEKIPKHLKLFEKFN

FDDTTKVPACTTISQLRKLFPHPVWEEKREEIWHCFYFYDDNTLLFEKLQKDYALQTNDLEKIKKIRLSESYGNVSLKAIRRI

NPYLKKGYAYSTAVLLGGIRNSFGKRFEYFKEYEPEIEKAVCRILKEKNAEGEVIRKIKDYLVHNRFGFAKNDRAFQKLYHHS

QAITTQAQKERLPETGNLRNPIVQQGLNELRRTVNKLLATCREKYGPSFKFDHIHVEMGRELRSSKTEREKQSRQIRENEKKN

EAAKVKLAEYGLKAYRDNIQKYLLYKEIEEKGGTVCCPYTGKTLNISHTLGSDNSVQIEHIIPYSISLDDSLANKTLCDATFN

REKGELTPYDFYQKDPSPEKWGASSWEEIEDRAFRLLPYAKAQRFIRRKPQESNEFISRQLNDTRYISKKAVEYLSAICSDVK

AFPGQLTAELRHLWGLNNILQSAPDITFPLPVSATENHREYYVITNEQNEVIRLFPKQGETPRTEKGELLLTGEVERKVFRCK

GMQEFQTDVSDGKYWRRIKLSSSVTWSPLFAPKPISADGQIVLKGRIEKGVFVCNQLKQKLKTGLPDGSYWISLPVISQTFKE

GESVNNSKLTSQQVQLFGRVREGIFRCHNYQCPASGADGNFWCTLDTDTAQPAFTPIKNAPPGVGGGQIILTGDVDDKGIFHA

DDDLHYELPASLPKGKYYGIFTVESCDPTLIPIELSAPKTSKGENLIEGNIWVDEHTGEVRFDPKKNREDQRHHAIDAIVIAL

SSQSLFQRLSTYNARRENKKRGLDSTEHFPSPWPGFAQDVRQSVVPLLVSYKQNPKTLCKISKTLYKDGKKIHSCGNAVRGQL

HKETVYGQRTAPGATEKSYHIRKDIRELKTSKHIGKVVDITIRQMLLKHLQENYHIDITQEFNIPSNAFFKEGVYRIFLPNKH

GEPVPIKKIRMKEELGNAERLKDNINQYVNPRNNHHVMIYQDADGNLKEEIVSFWSVIERQNQGQPIYQLPREGRNIVSILQI

NDTFLIGLKEEEPEVYRNDLSTLSKHLYRVQKLSGMYYTFRHHLASTLNNEREEFRIQSLEAWKRANPVKVQIDEIGRITFLN

GPLC

SEQ ID NO: 38

MESSQILSPIGIDLGGKFTGVCLSHLEAFAELPNHANTKYSVILIDHNNFQLSQAQRRATRHRVRNKKRNQFVKRVALQLFQH

ILSRDLNAKEETALCHYLNNRGYTYVDTDLDEYIKDETTINLLKELLPSESEHNFIDWFLQKMQSSEFRKILVSKVEEKKDDK

-continued

ELKNAVKNIKNFITGFEKNSVEGHRHRKVYFENIKSDITKDNQLDSIKKKIPSVCLSNLLGHLSNLQWKNLHRYLAKNPKQFD
EQTFGNEFLRMLKNFRHLKGSQESLAVRNLIQQLEQSQDYISILEKTPPEITIPPYEARTNTGMEKDQSLLLNPEKLNNLYPN
WRNLIPGIIDAHPFLEKDLEHTKLRDRKRIISPSKQDEKRDSYILQRYLDLNKKIDKFKIKKQLSFLGQGKQLPANLIETQKE
METHFNSSLVSVLIQIASAYNKEREDAAQGIWFDNAFSLCELSNINPPRKQKILPLLVGAILSEDFINNKDKWAKFKIFWNTH
KIGRTSLKSKCKEIEEARKNSGNAFKIDYEEALNHPEHSNNKALIKIIQTIPDIIQAIQSHLGHNDSQALIYHNPFSLSQLYT
ILETKRDGFHKNCVAVTCENYWRSQKTEIDPEISYASRLPADSVRPFDGVLARMMQRLAYEIAMAKWEQIKHIPDNSSLLIPI
YLEQNRFEFEESFKKIKGSSSDKTLEQAIEKQNIQWEEKFQRIINASMNICPYKGASIGGQGEIDHIYPRSLSKKHFGVIFNS
EVNLIYCSSQGNREKKEEHYLLEHLSPLYLKHQFGTDNVSDIKNFISQNVANIKKYISFHLLTPEQQKAARHALFLDYDDEAF
KTITKFLMSQQKARVNGTQKFLGKQIMEFLSTLADSKQLQLEFSIKQITAEEVHDHRELLSKQEPKLVKSRQQSFPSHAIDAT
LTMSIGLKEFPQFSQELDNSWFINHLMPDEVHLNPVRSKEKYNKPNISSTPLFKDSLYAERFIPVWVKGETFAIGFSEKDLFE
IKPSNKEKLFTLLKTYSTKNPGESLQELQAKSKAKWLYFPINKTLALEFLHHYFHKEIVTPDDTTVCHFINSLRYYTKKESIT
VKILKEPMPVLSVKFESSKKNVLGSFKHTIALPATKDWERLFNHPNFLALKANPAPNPKEFNEFIRKYFLSDNNPNSDIPNNG
HNIKPQKHKAVRKVFSLPVIPGNAGTMMRIRRKDNKGQPLYQLQTIDDTPSMGIQINEDRLVKQEVLMDAYKTRNLSTIDGIN
NSEGQAYATFDNWLTLPVSTFKPEIIKLEMKPHSKTRRYIRITQSLADFIKTIDEALMIKPSDSIDDPLNMPNEIVCKNKLFG
NELKPRDGKMKIVSTGKIVTYEFESDSTPQWIQTLYVTQLKKQP

SEQ ID NO: 39

MKKIVGLDLGTNSIGWALINAYINKEHLYGIEACGSRIIPMDAAILGNFDKGNSISQTADRTSYRGIRRLRERHLLRRERLHR
ILDLLGFLPKHYSDSLNRYGKFLNDIECKLPWVKDETGSYKFIFQESFKEMLANFTEHHPILIANNKKVPYDWTIYYLRKKAL
TQKISKEELAWILLNFNQKRGYYQLRGEEEETPNKLVEYYSLKVEKVEDSGERKGKDTWYNVHLENGMIYRRTSNIPLDWEGK
TKEFIVTTDLEADGSPKKDKEGNIKRSFRAPKDDDWTLIKKKTEADIDKIKMTVGAYIYDTLLQKPDQKIRGKLVRTIERKYY
KNELYQILKTQSEFHEELRDKQLYIACLNELYPNNEPRRNSISTRDFCHLFIEDIIFYQRPLKSKKSLIDNCPYEENRYIDKE
SGEIKHASIKCIAKSHPLYQEFRLWQFIVNLRIYRKETDVDVTQELLPTEADYVTLFEWLNEKKEIDQKAFFKYPPFGFKKTT
SNYRWNYVEDKPYPCNETHAQIIARLGKAHIPKAFLSKEKEETLWHILYSIEDKQEIEKALHSFANKNNLSEEFIEQFKNFPP
FKKEYGSYSAKAIKKLLPLMRMGKYWSIENIDNGTRIRINKIIDGEYDENIRERVRQKAINLTDITHFRALPLWLACYLVYDR
HSEVKDIVKWKTPKDIDLYLKSFKQHSLRNPIVEQVITETLRTVRDIWQQVGHIDEIHIELGREMKNPADKRARMSQQMIKNE
NTNLRIKALLTEFLNPEFGIENVRPYSPSQQDLLRIYEEGVLNSILELPEDIGIILGKFNQTDTLKRPTRSEILRYKLWLEQK
YRSPYTGEMIPLSKLFTPAYEIEHIIPQSRYFDDSLSNKVICESEINKLKDRSLGYEFIKNHHGEKVELAFDKPVEVLSVEAY
EKLVHESYSHNRSKMKKLLMEDIPDQFIERQLNDSRYISKVVKSLLSNIVREENEQEAISKNVIPCTGGITDRLKKDWGINDV
WNKIVLPRFIRLNELTESTRFTSINTNNTMIPSMPLELQKGFNKKRIDHRHHAMDAIIIACANRNIVNYLNNVSASKNTKITR
RDLQTLLCHKDKTDNNGNYKWVIDKPWETFTQDTLTALQKITVSFKQNLRVINKTTNHYQHYENGKKIVSNQSKGDSWAIRKS
MHKETVHGEVNLRMIKTVSFNEALKKPQAIVEMDLKKKILAMLELGYDTKRIKNYFEENKDTWQDINPSKIKVYYFTKETKDR
YFAVRKPIDTSFDKKKIKESITDTGIQQIMLRHLETKDNDPTLAFSPDGIDEMNRNILILNKGKKHQPIYKVRVYEKAEKFTV
GQKGNKRTKFVEAAKGTNLFFAIYETEEIDKDTKKVIRKRSYSTIPLNVVIERQKQGLSSAPEDENGNLPKYILSPNDLVYVP
TQEEINKGEVVMPIDRDRIYKMVDSSGITANFIPASTANLIFALPKATAEIYCNGENCIQNEYGIGSPQSKNQKAITGEMVKE
ICFPIKVDRLGNIIQVGSCILTN

SEQ ID NO: 40

MSRSLTFSFDIGYASIGWAVIASASHDDADPSVCGCGTVLFPKDDCQAFKRREYRRLRRNIRSRRVRIERIGRLLVQAQIITP
EMKETSGHPAPFYLASEALKGHRTLAPIELWHVLRWYAHNRGYDNNASWSNSLSEDGGNGEDTERVKHAQDLMDKHGTATMAE
TICRELKLEEGKADAPMEVSTPAYKNLNTAFPRLIVEKEVRRILELSAPLIPGLTAEIIELIAQHHPLTTEQRGVLLQHGIKL
ARRYRGSLLFGQLIPRFDNRIISRCPVTWAQVYEAELKKGNSEQSARERAEKLSKVPTANCPEFYEYRMARILCNIRADGEPL
SAEIRRELMNQARQEGKLTKASLEKAISSRLGKETETNVSNYFTLHPDSEEALYLNPAVEVLQRSGIGQILSPSVYRIAANRL
RRGKSVTPNYLLNLLKSRGESGEALEKKIEKESKKKEADYADTPLKPKYATGRAPYARTVLKKVVEEILDGEDPTRPARGEAH

-continued

PDGELKAHDGCLYCLLDTDSSVNQHQKERRLDTMTNNHLVRHRMLILDRLLKDLIQDFADGQKDRISRVCVEVGKELTTFSAM
DSKKIQRELTLRQKSHTDAVNRLKRKLPGKALSANLIRKCRIAMDMNWTCPFTGATYGDHELENLELEHIVPHSFRQSNALSS
LVLTWPGVNRMKGQRTGYDFVEQEQENPVPDKPNLHICSLNNYRELVEKLDDKKGHEDDRRRKKKRKALLMVRGLSHKHQSQN
HEAMKEIGMTEGMMTQSSHLMKLACKSIKTSLPDAHIDMIPGAVTAEVRKAWDVFGVFKELCPEAADPDSGKILKENLRSLTH
LHHALDACVLGLIPYIIPAHHNGLLRRVLAMRRIPEKLIPQVRPVANQRHYVLNDDGRMMLRDLSASLKENIREQLMEQRVIQ
HVPADMGGALLKETMQRVLSVDGSGEDAMVSLSKKKDGKKEKNQVKASKLVGVFPEGPSKLKALKAAIEIDGNYGVALDPKPV
VIRHIKVFKRIMALKEQNGGKPVRILKKGMLIHLTSSKDPKHAGVWRIESIQDSKGGVKLDLQRAHCAVPKNKTHECNWREVD
LISLLKKYQMKRYPTSYTGTPR

SEQ ID NO: 41

MTQKVLGLDLGTNSIGSAVRNLDLSDDLQWQLEFFSSDIFRSSVNKESNGREYSLAAQRSAHRRSRGLNEVRRRRLWATLNLL
IKHGFCPMSSESLMRWCTYDKRKGLFREYPIDDKDFNAWILLDFNGDGRPDYSSPYQLRRELVTRQFDFEQPIERYKLGRALY
HIAQHRGFKSSKGETLSQQETNSKPSSTDEIPDVAGAMKASEEKLSKGLSTYMKEHNLLTVGAAFAQLEDEGVRRNNNDYRA
IRSQFQHEIETIFKFQQGLSVESELYERLISEKKNVGTIFYKRPLRSQRGNVGKCTLERSKPRCAIGHPLFEKFRAWTLINNI
KVRMSVDTLDEQLPMKLRLDLYNECFLAFVRTEFKFEDIRKYLEKRLGIHFSYNDKTINYKDSTSVAGCPITARFRKMLGEEW
ESFRVEGQKERQAHSKNNISFHRVSYSIEDIWHFCYDAEEPEAVLAFAQETLRLERKKAEELVRIWSAMPQGYAMLSQKAIRN
INKILMLGLKYSDAVILAKVPELVDVSDEELLSIAKDYYLVEAQVNYDKRINSIVNGLIAKYKSVSEEYRFADHNYEYLLDES
DEKDIIRQIENSLGARRWSLMDANEQTDILQKVRDRYQDFFRSHERKFVESPKLGESFENYLTKKFPMVEREQWKKLYHPSQI
TIYRPVSVGKDRSVLRLGNPDIGAIKNPTVLRVLNTLRRRVNQLLDDGVISPDETRVVETARELNDANRKWALDTYNRIRHD
ENEKIKKILEEFYPKRDGISTDDIDKARYVIDQREVDYFTGSKTYNKDIKKYKFWLEQGGQCMYTGRTINLSNLFDPNAFDIE
HTIPESLSFDSSDMNLTLCDAHYNRFIKKNHIPTDMPNYDKAITIDGKEYPAITSQLQRWVERVERLNRNVEYWKGQARRAQN
KDRKDQCMREMHLWKMELEYWKKKLERFTVIEVIDGFKNSQLVDTRVITRHAVLYLKSIFPHVDVQRGDVTAKFRKILGIQSV
DEKKDRSLHSHHAIDATTLTIIPVSAKRDRMLELFAKIEEINKMLSFSGSEDRTGLIQELEGLKNKLQMEVKVCRIGHNVSEI
GTFINDNIIVNHHIKNQALTPVRRLRKKGYIVGGVDNPRWQTGDALRGEIHKASYYGAITQFAKDDEGKVLMKEGRPQVNPT
IKFVIRRELKYKKSAADSGFASWDDLGKAIVDKELFALMKGQFPAETSFKDACEQGIYMIKKGKNGMPDIKLHHIRHVRCEAP
QSGLKIKEQTYKSEKEYKRYFYAAVGDLYAMCCYTNGKIREFRIYSLYDVSCHRKSDIEDIPEFITDKKGNRLMLDYKLRTGD
MILLYKDNPAELYDLDNVNLSRRLYKINRFESQSNLVLMTHHLSTSKERGRSLGKTVDYQNLPESIRSSVKSLNFLIMGENRD
FVIKNGKIIFNHR

SEQ ID NO: 42

MLVSPISVDLGGKNTGFFSFTDSLDNSQSGTVIYDESFVLSQVGRRSKRHSKRNNLRNKLVKRLFLLILQEHHGLSIDVLPDE
IRGLFNKRGYTYAGFELDEKKKDALESDTLKEFLSEKLQSIDRDSDVEDFLNQIASNAESFKDYKKGFEAVFASATHSPNKKL
ELKDELKSEYGENAKELLAGLRVTKEILDEFDKQENQGNLPRAKYFEELGEYIATNEKVKSFFDSNSLKLTDMTKLIGNISNY
QLKELRRYFNDKEMEKGDIWIPNKLHKITERFVRSWHPKNDADRQRRAELMKDLKSKEIMELLTTTEPVMTIPPYDDMNNRGA
VKCQTLRLNEEYLDKHLPNWRDIAKRLNHGKFNDDLADSTVKGYSEDSTLLHRLLDTSKEIDIYELRGKKPNELLVKTLGQSD
ANRLYGFAQNYYELIRQKVRAGIWVPVKNKDDSLNLEDNSNMLKRCNHNPPHKKNQIHNLVAGILGVKLDEAKFAEFEKELWS
AKVGNKKLSAYCKNIEELRKTHGNTFKIDIEELRKKDPAELSKEEKAKLRLTDDVILNEWSQKIANFFDIDDKHRQRFNNLFS
MAQLHTVIDTPRSGFSSTCKRCTAENRFRSETAFYNDETGEFHKKATATCQRLPADTQRPFSGKIERYIDKLGYELAKIKAKE
LEGMEAKEIKVPIILEQNAFEYEESLRKSKTGSNDRVINSKKDRDGKKLAKAKENAEDRLKDKDKRIKAFSSGICPYCGDTIG
DDGEIDHILPRSHTLKIYGTVFNPEGNLIYVHQKCNQAKADSIYKLSDIKAGVSAQWIEEQVANIKGYKTFSVLSAEQQKAFR
YALFLQNDNEAYKKVVDWLRTDQSARVNGTQKYLAKKIQEKLTKMLPNKHLSFEFILADATEVSELRRQYARQNPLLAKAEKQ
APSSHAIDAVMAFVARYQKVFKDGTPPNADEVAKLAMLDSWNPASNEPLTKGLSTNQKIEKMIKSGDYGQKNMREVFGKSIFG
ENAIGERYKPIVVQEGGYYIGYPATVKKGYELKNCKVVTSKNDIAKLEKIIKNQDLISLKENQYIKIFSINKQTISELSNRYF

```
NMNYKNLVERDKEIVGLLEFIVENCRYYTKKVDVKFAPKYIHETKYPFYDDWRRFDEAWRYLQENQNKTSSKDRFVIDKSSLN

EYYQPDKNEYKLDVDTQPIWDDFCRWYFLDRYKTANDKKSIRIKARKTFSLLAESGVQGKVFRAKRKIPTGYAYQALPMDNNV

IAGDYANILLEANSKTLSLVPKSGISIEKQLDKKLDVIKKTDVRGLAIDNNSFFNADFDTHGIRLIVENTSVKVGNFPISAID

KSAKRMIFRALFEKEKGKRKKKTTISFKESGPVQDYLKVFLKKIVKIQLRTDGSISNIVVRKNAADFTLSFRSEHIQKLLK
```

SEQ ID NO: 43

```
MAYRLGLDIGITSVGWAVVALEKDESGLKPVRIQDLGVRIFDKAEDSKTGASLALPRREARSARRRTRRRRHRLWRVKRLLEQ

HGILSMEQIEALYAQRTSSPDVYALRVAGLDRCLIAEEIARVLIHIAHRRGFQSNRKSEIKDSDAGKLLKAVQENENLMQSKG

YRTVAEMLVSEATKTDAEGKLVHGKKHGYVSNVRNKAGEYRHTVSRQAIVDEVRKIFAAQRALGNDVMSEELEDSYLKILCSQ

RNFDDGPGGDSPYGHGSVSPDGVRQSIYERMVGSCTFETGEKRAPRSSYSFERFQLLTKVVNLRIYRQQEDGGRYPCELTQTE

RARVIDCAYEQTKITYGKLRKLLDMKDTESFAGLTYGLNRSRNKTEDTVFVEMKFYHEVRKALQRAGVFIQDLSIETLDQIGW

ILSVWKSDDNRRKKLSTLGLSDNVIEELLPLNGSKFGHLSLKAIRKILPFLEDGYSYDVACELAGYQFQGKTEYVKQRLLPPL

GEGEVTNPVVRRALSQAIKVVNAVIRKHGSPESIHIELARELSKNLDERRKIEKAQKENQKNNEQIKDEIREILGSAHVTGRD

IVKYKLFKQQQEFCMYSGEKLDVTRLFEPGYAEVDHIIPYGISFDDSYDNKVLVKTEQNRQKGNRTPLEYLRDKPEQKAKFIA

LVESIPLSQKKKNHLLMDKRAIDLEQEGFRERNLSDTRYITRALMNHIQAWLLFDETASTRSKRVVCVNGAVTAYMRARWGLT

KDRDAGDKHHAADAVVVACIGDSLIQRVTKYDKFKRNALADRNRYVQQVSKSEGITQYVDKETGEVFTWESFDERKFLPNEPL

EPWPFFRDELLARLSDDPSKNIRAIGLLTYSETEQIDPIFVSRMPTRKVTGAAHKETIRSPRIVKVDDNKGTEIQVVVSKVAL

TELKLTKDGEIKDYFRPEDDPRLYNTLRERLVQFGGDAKAAFKEPVYKISKDGSVRTPVRKVKIQEKLTLGVPVHGGRGIAEN

GGMVRIDVFAKGGKYYFVPIYVADVLKRELPNRLATAHKPYSEWRVVDDSYQFKFSLYPNDAVMIKPSREVDITYKDRKEPVG

CRIMYFVSANIASASISLRTHDNSGELEGLGIQGLEVFEKYVVGPLGDTHPVYKERRMPFRVERKMN
```

SEQ ID NO: 44

```
MPVLSPLSPNAAQGRRRWSLALDIGEGSIGWAVAEVDAEGRVLQLTGTGVTLFPSAWSNENGTYVAHGAADRAVRGQQQRHDS

RRRRLAGLARLCAPVLERSPEDLKDLTRTPPKADPRAIFFLRADAARRPLDGPELFRVLHHMAAHRGIRLAELQEVDPPPESD

ADDAAPAATEDEDGTRRAAADERAFRRLMAEHMRHGTQPTCGEIMAGRLRETPAGAQPVTRARDGLRVGGGVAVPTRALIEQ

EFDAIRAIQAPRHPDLPWDSLRRLVLDQAPIAVPPATPCLFLEELRRRGETFQGRTITREAIDRGLTVDPLIQALRIRETVGN

LRLHERITEPDGRQRYVPRAMPELGLSHGELTAPERDTLVRALMHDPDGLAAKDGRIPYTRLRKLIGYDNSPVCFAQERDTSG

GGITVNPTDPLMARWIDGWVDLPLKARSLYVRDVVARGADSAALARLLAEGAHGVPPVAAAAVPAATAAILESDIMQPGRYSV

CPWAAEAILDAWANAPTEGFYDVTRGLFGFAPGEIVLEDLRRARGALLAHLPRTMAAARTPNRAAQQRGPLPAYESVIPSQLI

TSLRRAHKGRAADWSAADPEERNPFLRTWTGNAATDHILNQVRKTANEVITKYGNRRGWDPLPSRITVELAREAKHGVIRRNE

IAKENRENEGRRKKESAALDTFCQDNTVSWQAGGLPKERAALRLRLAQRQEFFCPYCAERPKLRATDLFSPAETEIDHVIERR

MGGDGPDNLVLAHKDCNNAKGKKTPHEHAGDLLDSPALAALWQGWRKENADRLKGKGHKARTPREDKDFMDRVGWRFEEDARA

KAEENQERRGRRMLHDTARATRLARLYLAAAVMPEDPAEIGAPPVETPPSPEDPTGYTAIYRTISRVQPVNGSVTHMLRQRLL

QRDKNRDYQTHHAEDACLLLLAGPAVVQAFNTEAAQHGADAPDDRPVDLMPTSDAYHQQRRARALGRVPLATVDAALADIVMP

ESDRQDPETGRVHWRLTRAGRGLKRRIDDLTRNCVILSRPRRPSETGTPGALHNATHYGRREITVDGRTDTVVTQRMNARDLV

ALLDNAKIVPAARLDAAAPGDTILKEICTEIADRHDRVVDPEGTHARRWISARLAALVPAHAEAVARDIAELADLDALADADR

TPEQEARRSALRQSPYLGRAISAKKADGRARAREQEILTRALLDPHWGPRGLRHLIMREARAPSLVRIRANKTDAFGRPVPDA

AVWVKTDGNAVSQLWRLTSVVTDDGRRIPLPKPIEKRIEISNLEYARLNGLDEGAGVTGNNAPPRPLRQDIDRLTPLWRDHGT

APGGYLGTAVGELEDKARSALRGKAMRQTLTDAGITAEAGWRLDSEGAVCDLEVAKGDTVKKDGKTYKVGVITQGIFGMPVDA

AGSAPRTPEDCEKFEEQYGIKPWKAKGIPLA
```

SEQ ID NO: 45

```
MNYTEKEKLFMKYILALDIGIASVGWAILDKESETVIEAGSNIFPEASAADNQLRRDMRGAKRNNRRLKTRINDFIKLWENNN

LSIPQFKSTEIVGLKVRAITEEITLDELYLILYSYLKHRGISYLEDALDDTVSGSSAYANGLKLNAKELETHYPCEIQQERLN

TIGKYRGQSQIINENGEVLDLSNVFTIGAYRKEIQRVFEIQKKYHPELTDEFCDGYMLIFNRKRKYYEGPGNEKSRTDYGRFT
```

-continued

TKLDANGNYITEDNIFEKLIGKCSVYPDELRAAAASYTAQEYNVLNDLNNLTINGRKLEENEKHEIVERIKSSNTINMRKIIS
DCMGENIDDFAGARIDKSGKEIFHKFEVYNKMRKALLEIGIDISNYSREELDEIGYIMTINTDKEAMMEAFQKSWIDLSDDVK
QCLINMRKTNGALFNKWQSFSLKIMNELIPEMYAQPKEQMTLLTEMGVTKGTQEEFAGLKYIPVDVVSEDIFNPVVRRSVRIS
FKILNAVLKKYKALDTIVIEMPRDRNSEEQKKRINDSQKLNEKEMEYIEKKLAVTYGIKLSPSDFSSQKQLSLKLKLWNEQDG
ICLYSGKTIDPNDIINNPQLFEIDHIIPRSISFDDARSNKVLVYRSENQKKGNQTPYYYLTHSHSEWSFEQYKATVMNLSKKK
EYAISRKKIQNLLYSEDITKMDVLKGFINRNINDTSYASRLVLNTIQNFFMANEADTKVKVIKGSYTHQMRCNLKLDKNRDES
YSHHAVDAMLIGYSELGYEAYHKLQGEFIDFETGEILRKDMWDENMSDEVYADYLYGKKWANIRNEVVKAEKNVKYWHYVMRK
SNRGLCNQTIRGTREYDGKQYKINKLDIRTKEGIKVFAKLAFSKKDSDRERLLVYLNDRRTFDDLCKIYEDYSDAANPFVQYE
KETGDIIRKYSKKHNGPRIDKLKYKDGEVGACIDISHKYGFEKGSKKVILESLVPYRMDVYYKEENHSYYLVGVKQSDIKFEK
GRNVIDEEAYARILVNEKMIQPGQSRADLENLGFKFKLSFYKNDIIEYEKDGKIYTERLVSRTMPKQRNYIETKPIDKAKFEK
QNLVGLGKTKFIKKYRYDILGNKYSCSEEKFTSFC

SEQ ID NO: 46

MLRLYCANNLVLNNVQNLWKYLLLLIFDKKIIFLFKIKVILIRRYMENNNKEKIVIGFDLGVASVGWSIVNAETKEVIDLGVR
LFSEPEKADYRRAKRTTRRLLRRKKFKREKPHKLILKNAEIFGLQSRNEILNVYKDQSSKYRNILKLKINALKEEIKPSELVW
ILRDYLQNRGYFYKNEKLTDEFVSNSFPPSKKLHEHYEKYGFFRGSVKLDNKLDNKKDKAKEKDEEEESDAKKESEELIFSNKQ
WINEIVKVFENQSYLTESFKEEYLKLFNYVRPFNKGPGSKNSRTAYGVFSTDIDPETNKFKDYSNIWDKTIGKCSLFEEEIRA
PKNLPSALIFNLQNEICTIKNEFTEFKNWWLNAEQKSEILKFVFTELFNWKDKKYSDKKFNKNLQDKIKKYLLNFALENFNLN
EEILKNRDLENDTVLGLKGVKYYEKSNATADAALEFSSLKPLYVFIKFLKEKKLDLNYLLGLENTEILYFLDSIYLAISYSSD
LKERNEWFKKLLKELYPKIKNNNLEIIENVEDIFEITDQEKFESFSKTHSLSREAFNHIIPLLLSNNEGKNYESLKHSNEELK
KRTEKAELKAQQNQKYLKDNFLKEALVPLSVKTSVLQAIKIFNQIIKNFGKKYEISQVVIEMARELTKPNLEKLLNNATNSNI
KILKEKLDQTEKFDDFTKKKFIDKIENSVVFRNKLFLWFEQDRKDPYTQLDIKINEIEDETEIDHVIPYSKSADDSWFNKLLV
KKSTNQLKKNKTVWEYYQNESDPEAKWNKFVAWAKRIYLVQKSDKESKDNSEKNSIFKNKKPNLKFKNITKKLFDPYKDLGFL
ARNLNDTRYATKVFRDQLNNYSKHHSKDDENKLFKWCMNGSITSFLRKSMVVRKNEEQVYRFNFWKKDRDQFFHHAVDASIIA
IFSLLTKTLYNKLRVYESYDVQRREDGVYLINKETGEVKKADKDYWKDQHNFLKIRENAIEIKNVLNNVDFQNQVRYSRKANT
KLNTQLFNETLYGVKEFENNFYKLEKVNLFSRKDLRKFILEDLNEESEKNKKNENGSRKRILTEKYIVDEILQILENEEFKDS
KSDINALNKYMDSLPSKFSEFFSQDFINKCKKENSLILTFDAIKHNDPKKVIKIKNLKFFREDATLKNKQAVHKDSKNQIKSF
YESYKCVGFIWLKNKNDLEESIFVPINSRVIHFGDKDKDIFDFDSYNKEKLLNEINLKRPENKKFNSINEIEFVKFVKPGALL
LNFENQQIYYISTLESSSLRAKIKLLNKMDKGKAVSMKKITNPDEYKIIEHVNPLGINLNWTKKLENNN

SEQ ID NO: 47

MLMSKHVLGLDLGVGSIGWCLIALDAQGDPAEILGMGSRVVPLNNATKAIEAFNAGAAFTASQERTARRTMRRGFARYQLRRY
RLRRELEKVGMLPDAALIQLPLLELWELRERAATAGRRLTLPELGRVLCHINQKRGYRHVKSDAAAIVGDEGEKKKDSNSAYL
AGIRANDEKLQAEHKTVGQYFAEQLRQNQSESPTGGISYRIKDQIFSRQCYIDEYDQIMAVQRVHYPDILTDEFIRMLRDEVI
FMQRPLKSCKHLVSLCEFEKQERVMRVQQDDGKGGWQLVERRVKFGPKVAPKSSPLFQLCCIYEAVNNIRLTRPNGSPCDITP
EERAKIVAHLQSSASLSFAALKKLLKEKALIADQLTSKSGLKGNSTRVALASALQPYPQYHHLLDMELETRMMTVQLTDEETG
EVTEREVAVVTDSYVRKPLYRLWHILYSIEEREAMRRALITQLGMKEEDLDGGLLDQLYRLDFVKPGYGNKSAKFICKLLPQL
QQGLGYSEACAAVGYRHSNSPTSEEITERTLLEKIPLLQRNELRQPLVEKILNQMINLVNALKAEYGIDEVRVELARELKMSR
EERERMARNNKDREERNKGVAAKIRECGLYPTKPRIQKYMLWKEAGRQCLYCGRSIEEEQCLREGGMEVEHIIPKSVLYDDSY
GNKTCACRRCNKEKGNRTALEYIRAKGREAEYMKRINDLLKEKKISYSKHQRLRWLKEDIPSDFLERQLRLTQYISRQAMAIL
QQGIRRVSASEGGVTARLRSLWGYGKILHTLNLDRYDSMGETERVSREGEATEELHITNWSKRMDHRHHAIDALVVACTRQSY
IQRLNRLSSEFGREDKKKEDQEAQEQQATETGRLSNLERWLTQRPHFSVRTVSDKVAEILISYRPGQRVVTGRGNIYRKKMAD
GREVSCVQRGVLVPRGELMEASFYGKILSQGRVRIVKRYPLHDLKGEVVDPHLRELITTYNQELKSREKGAPIPPLCLDKDKK

-continued

QEVRSVRCYAKTLSLDKAIPMCFDEKGEPTAFVKSASNHHLALYRTPKGKLVESIVTFWDAVDRARYGIPLVITHPREVMEQV

LQRGDIPEQVLSLLPPSDWVFVDSLQQDEMVVIGLSDEELQRALEAQNYRKISEHLYRVQKMSSSYYVFRYHLETSVADDKNT

SGRIPKFHRVQSLKAYEERNIRKVRVDLLGRISLL

SEQ ID NO: 48

MSDLVLGLDIGIGSVGVGILNKVTGEIIHKNSRIFPAAQAENNLVRRTNRQGRRLARRKKHRRVRLNRLFEESGLITDFTKIS

INLNPYQLRVKGLTDELSNEELFIALKNMVKHRGISYLDDASDDGNSSVGDYAQIVKENSKQLETKTPGQIQLERYQTYGQLR

GDFTVEKDGKKHRLINVFPTSAYRSEALRILQTQQEFNPQITDEFINRYLEILTGKRKYYHGPGNEKSRTDYGRYRTSGETLD

NIFGILIGKCTFYPDEFRAAKASYTAQEFNLLNDLNNLTVPTETKKLSKEQKNQIINYVKNEKAMGPAKLFKYIAKLLSCDVA

DIKGYRIDKSGKAEIHTFEAYRKMKTLETLDIEQMDRETLDKLAYVLTLNTEREGIQEALEHEFADGSFSQKQVDELVQFRKA

NSSIFGKGWHNFSVKLMMELIPELYETSEEQMTILTRLGKQKTTSSSNKTKYIDEKLLTEEIYNPVVAKSVRQAIKIVNAAIK

EYGDFDNIVIEMARETNEDDEKKAIQKIQKANKDEKDAAMLKAANQYNGKAELPHSVFHGHKQLATKIRLWHQQGERCLYTGK

TISIHDLINNSNQFEVDHILPLSITFDDSLANKVLVYATANQEKGQRTPYQALDSMDDAWSFRELKAFVRESKTLSNKKKEYL

LTEEDISKFDVRKKFIERNLVDTRYASRVVLNALQEHFRAHKIDTKVSVVRGQFTSQLRRHWGIEKTRDTYHHHAVDALIIAA

SSQLNLWKKQKNTLVSYSEDQLLDIETGELISDDEYKESVFKAPYQHFVDTLKSKEFEDSILFSYQVDSKFNRKISDATIYAT

RQAKVGKDKADETYVLGKIKDIYTQDGYDAFMKIYKKDKSKFLMYRHDPQTFEKVIEPILENYPNKQINEKGKEVPCNPFLKY

KEEHGYIRKYSKKGNGPEIKSLKYYDSKLGNHIDITPKDSNNKVVLQSVSPWRADVYFNKTTGKYEILGLKYADLQFEKGTGT

YKISQEKYNDIKKKEGVDSDSEFKFTLYKNDLLLVKDTETKEQQLFRFLSRTMPKQKHYVELKPYDKQKFEGGEALIKVLGNV

ANSGQCKKGLGKSNISIYKVRTDVLGNQHIIKNEGDKPKLDF

SEQ ID NO: 49

MNAEHGKEGLLIMEENFQYRIGLDIGITSVGWAVLQNNSQDEPVRITDLGVRIFDVAENPKNGDALAAPRRDARTTRRRLRRR

RHRLERIKFLLQENGLIEMDSFMERYYKGNLPDVYQLRYEGLDRKLKDEELAQVLIHIAKHRGFSTRKAETKEKEGGAVLKA

TTENQKIMQEKGYRTVGEMLYLDEAFHTECLWNEKGYVLTPRNRPDDYKHTILRSMLVEEVHAIFAAQRAHGNQKATEGLEEA

YVEIMTSQRSFDMGPGLQPDGKPSPYAMEGFGDRVGKCTFEKDEYRAPKATYTAELFVALQKINHTKLIDEFGTGRFFSEEER

KTIIGLLLSSKELKYGTIRKKLNIDPSLKFNSLNYSAKKEGETEEERVLDTEKAKFASMFWTYEYSKCLKDRTEEMPVGEKAD

LFDRIGEILTAYKNDDSRSSRLKELGLSGEEIDGLLDLSPAKYQRVSLKAMRKMQPYLEDGLIYDKACEAAGYDFRALNDGNK

KHLLKGEEINAIVNDITNPVVKRSVSQTIKVINAIIQKYGSPQAVNIELAREMSKNFQDRTNLEKEMKKRQQENERAKQQIIE

LGKQNPTGQDILKYRLWNDQGGYCLYSGKKIPLEELFDGGYDIDHILPYSITFDDSYRNKVLVTAQENRQKGNRTPYEYFGAD

EKRWEDYEASVRLLVRDYKKQQKLLKKNFTEEERKEFKERNLNDTKYITRVVYNMIRQNLELEPFNHPEKKKQVWAVNGAVTS

YLRKRWGLMQKDRSTDRHHAMDAVVIACCTDGMIHKISRYMQGRELAYSRNFKFPDEETGEILNRDNFTREQWDEKFGVKVPL

PWNSFRDELDIRLLNEDPKNFLLTHADVQRELDYPGWMYGEEESPIEEGRYINYIRPLFVSRMPNHKVTGSAHDATIRSARDY

ETRGVVITKVPLTDLKLNKDNEIEGYYDKDSDRLLYQALVRQLLLHGNDGKKAFAEDFHKPKADGTEGPVVRKVKIEKKQTSG

VMVRGGTGIAANGEMVRIDVFRENGKYYFVPVYTADVVRKVLPNRAATHTKPYSEWRVMDDANFVFSLYSRDLIHVKSKKDIK

TNLVNGGLLLQKEIFAYYTGADIATASIAGFANDSNFKFRGLGIQSLEIFEKCQVDILGNISVVRHENRQEFH

SEQ ID NO: 50

MRVLGLDAGIASLGWALIEIEESNRGELSQGTIIGAGTWMFDAPEEKTQAGAKLKSEQRRTFRGQRRVVRRRQRMNEVRRIL

HSHGLLPSSDRDALKQPGLDPWRIRAEALDRLLGPVELAVALGHIARHRGFKSNSKGAKTNDPADDTSKMKRAVNETREKLAR

FGSAAKMLVEDESFVLRQTPTKNGASEIVRRFRNREGDYSRSLLRDDLAAEMRALFTAQARFQSAIATADLQTAFTKAAFFQR

PLQDSEKLVGPCPFEVDEKRAPKRGYSFELFRFLSRLNHVTLRDGKQERTLTRDELALAAADFGAAAKVSFTALRKKLKLPET

TVFVGVKADEESKLDVVARSGKAAEGTARLRSVIVDALGELAWGALLCSPEKLDKIAEVISFRSDIGRISEGLAQAGCNAPLV

DALTAAASDGRFDPFTGAGHISSKAARNILSGLRQGMTYDKACCAADYDHTASRERGAFDVGGHGREALKRILQEERISRELV

GSPTARKALIESIKQVKAIVERYGVPDRIHVELARDVGKSIEEREEITRGIEKRNRQKDKLRGLFEKEVGRPPQDGARGKEEL

LRFELWSEQMGRCLYTDDYISPSQLVATDDAVQVDHILPWSRFADDSYANKTLCMAKANQDKKGRTPYEWFKAEKTDTEWDAF

-continued

IVRVEALADMKGFKKRNYKLRNAEEAAAKFRNRNLNDTRWACRLLAEALKQLYPKGEKDKDGKERRRVFSRPGALTDRLRRAW
GLQWMKKSTKGDRIPDDRHHALDAIVIAATTESLLQRATREVQEIEDKGLHYDLVKNVTPPWPGFREQAVEAVEKVFVARAER
RRARGKAHDATIRHIAVREGEQRVYERRKVAELKLADLDRVKDAERNARLIEKLRNWIEAGSPKDDPPLSPKGDPIFKVRLVT
KSKVNIALDTGNPKRPGTVDRGEMARVDVFRKASKKGKYEYYLVPIYPHDIATMKTPPIRAVQAYKPEDEWPEMDSSYEFCWS
LVPMTYLQVISSKGEIFEGYYRGMNRSVGAIQLSAHSNSSDVVQGIGARTLTEFKKFNVDRFGRKHEVERELRTWRGETWRGK
AYI

SEQ ID NO: 51
MGNYYLGLDVGIGSIGWAVINIEKKRIEDFNVRIFKSGEIQEKNRNSRASQQCRRSRGLRRLYRRKSHRKLRLKNYLSIIGLT
TSEKIDYYYETADNNVIQLRNKGLSEKLTPEEIAACLIHICNNRGYKDFYEVNVEDIEDPDERNEYKEEHDSIVLISNLMNEG
GYCTPAEMICNCREFDEPNSVYRKFHNSAASKNHYLITRHMLVKEVDLILENQSKYYGILDDKTIAKIKDIIFAQRDFEIGPG
KNERFRRFTGYLDSIGKCQFFKDQERGSRFTVIADIYAFVNVLSQYTYTNNRGESVFDTSFANDLINSALKNGSMDKRELKAI
AKSYHIDISDKNSDTSLTKCFKYIKVVKPLFEKYGYDWDKLIENYTDTDNNVLNRIGIVLSQAQTPKRRREKLKALNIGLDDG
LINELTKLKLSGTANVSYKYMQGSIEAFCEGDLYGKYQAKFNKEIPDIDENAKPQKLPPFKNEDDCEFFKNPVVFRSINETRK
LINAIIDKYGYPAAVNIETADELNKTFEDRAIDTKRNNDNQKENDRIVKEIIECIKCDEVHARHLIEKYKLWEAQEGKCLYSG
ETITKEDMLRDKDKLFEVDHIVPYSLILDNTINNKALVYAEENQKKGQRTPLMYMNEAQAADYRVRVNTMFKSKKCSKKKYQY
LMLPDLNDQELLGGWRSRNLNDTRYICKYLVNYLRKNLRFDRSYESSDEDDLKIRDHYRVFPVKSRFTSMFRRWWLNEKTWGR
YDKAELKKLTYLDHAADAIIIANCRPEYVVLAGEKLKLNKMYHQAGKRITPEYEQSKKACIDNLYKLFRMDRRTAEKLLSGHG
RLTPIIPNLSEEVDKRLWDKNIYEQFWKDDKDKKSCEELYRENVASLYKGDPKFASSLSMPVISLKPDHKYRGTITGEEAIRV
KEIDGKLIKLKRKSISEITAESINSIYTDDKILIDSLKTIFEQADYKDVGDYLKKTNQHFFTTSSGKRVNKVTVIEKVPSRWL
RKEIDDNNFSLLNDSSYYCIELYKDSKGDNNLQGIAMSDIVHDRKTKKLYLKPDFNYPDDYYTHVMYIFPGDYLRIKSTSKKS
GEQLKFEGYFISVKNVNENSFRFISDNKPCAKDKRVSITKKDIVIKLAVDLMGKVQGENNGKGISCGEPLSLLKEKN

SEQ ID NO: 52
MLSRQLLGASHLARPVSYSYNVQDNDVHCSYGERCFMRGKRYRIGIDVGLNSVGLAAVEVSDENSPVRLLNAQSVIHDGGVDP
QKNKEAITRKNMSGVARRTRRMRRRKRERLHKLDMLLGKFGYPVIEPESLDKPFEEWHVRAELATRYIEDDELRRESISIALR
HMARHRGWRNPYRQVDSLISDNPYSKQYGELKEKAKAYNDDATAAEEESTPAQLVVAMLDAGYAEAPRLRWRTGSKKPDAEGY
LPVRLMQEDNANELKQIFRVQRVPADEWKPLFRSVFYAVSPKGSAEQRVGQDPLAPEQARALKASLAFQEYRIANVITNLRIK
DASAELRKLTVDEKQSIYDQLVSPSSEDITWSDLCDFLGFKRSQLKGVGSLTEDGEERISSRPPRLTSVQRIYESDNKIRKPL
VAWWKSASDNEHEAMIRLLSNTVDIDKVREDVAYASAIEFIDGLDDDALTKLDSVDLPSGRAAYSVETLQKLTRQMLTTDDDL
HEARKTLFNVTDSWRPPADPIGEPLGNPSVDRVLKNVNRYLMNCQQRWGNPVSVNIEHVRSSFSSVAFARKDKREYEKNNEKR
SIFRSSLSEQLRADEQMEKVRESDLRRLEAIQRQNGQCLYCGRTITFRTCEMDHIVPRKGVGSTNTRTNFAAVCAECNRMKSN
TPFAIWARSEDAQTRGVSLAEAKKRVTMFTFNPKSYAPREVKAFKQAVIARLQQTEDDAAIDNRSIESVAWMADELHRRIDWY
FNAKQYVNSASIDDAEAETMKTTVSVFQGRVTASARRAAGIEGKIHFIGQQSKTRLDRRHHAVDASVIAMMNTAAAQTLMERE
SLRESQRLIGLMPGERSWKEYPYEGTSRYESFHLWLDNMDVLLELLNDALDNDRIAVMQSQRYVLGNSIAHDATIHPLEKVPL
GSAMSADLIRRASTPALWCALTRLPDYDEKEGLPEDSHREIRVHDTRYSADDEMGFFASQAAQIAVQEGSADIGSAIHHARVY
RCWKTNAKGVRKYFYGMIRVFQTDLLRACHDDLFTVPLPPQSISMRYGEPRVVQALQSGNAQYLGSLVVGDEIEMDFSSLDVD
GQIGEYLQFFSQFSGGNLAWKHWVVDGFFNQTQLRIRPRYLAAEGLAKAFSDDVVPDGVQKIVTKQGWLPPVNTASKTAVRIV
RRNAFGEPRLSSAHHMPCSWQWRHE

SEQ ID NO: 53
MYSIGLDLGISSVGWSVIDERTGNVIDLGVRLFSAKNSEKNLERRTNRGGRRLIRRKTNRLKDAKKILAAVGFYEDKSLKNSC
PYQLRVKGLTEPLSRGEIYKVTLHILKKRGISYLDEVDTEAAKESQDYKEQVRKNAQLLTKYTPGQIQLQRLKENNRVKTGIN
AQGNYQLNVFKVSAYANELATILKTQQAFYPNELTDDWIALFVQPGIAEEEAGLIYRKRPYYHGPGNEANNSPYGRWSDFQKTG
EPATNIFDKLIGKDFQGELRASGLSLSAQQYNLLNDLTNLKIDGEVPLSSEQKEYILTELMTKEFTRFGVNDVVKLLGVKKER

-continued

LSGWRLDKKGKPEIHTLKGYRNWRKIFAEAGIDLATLPTETIDCLAKVLTLNTEREGIENTLAFELPELSESVKLLVLDRYKE

LSQSISTQSWHRFSLKTLHLLIPELMNATSEQNTLLEQFQLKSDVRKRYSEYKKLPTKDVLAEIYNPTVNKTVSQAFKVIDAL

LVKYGKEQIRYITIEMPRDDNEEDEKKRIKELHAKNSQRKNDSQSYFMQKSGWSQEKFQTTIQKNRRFLAKLLYYYEQDGICA

YTGLPISPELLVSDSTEIDHIIPISISLDDSINNKVLVLSKANQVKGQQTPYDAWMDGSFKKINGKFSNWDDYQKWVESRHFS

HKKENNLLETRNIFDSEQVEKFLARNLNDTRYASRLVLNTLQSFFTNQETKVRVVNGSFTHTLRKKWGADLDKTRETHHHHAV

DATLCAVTSFVKVSRYHYAVKEETGEKVMREIDFETGEIVNEMSYWEFKKSKKYERKTYQVKWPNFREQLKPVNLHPRIKFSH

QVDRKANRKLSDATIYSVREKTEVKTLKSGKQKITTDEYTIGKIKDIYTLDGWEAFKKKQDKLLMKDLDEKTYERLLSIAETT

PDFQEVEEKNGKVKRVKRSPFAVYCEENDIPAIQKYAKKNNGPLIRSLKYYDGKLNKHINITKDSQGRPVEKTKNGRKVTLQS

LKPYRYDIYQDLETKAYYTVQLYYSDLRFVEGKYGITEKEYMKKVAEQTKGQVVRFCFSLQKNDGLEIEWKDSQRYDVRFYNF

QSANSINFKGLEQEMMPAENQFKQKPYNNGAINLNIAKYGKEGKKLRKFNTDILGKKHYLFYEKEPKNIIK

SEQ ID NO: 54

MYFYKNKENKLNKKVVLGLDLGIASVGWCLTDISQKEDNKFPIILHGVRLFETVDDSDDKLLNETRRKKRGQRRRNRRLFTRK

RDFIKYLIDNNIIELEFDKNPKILVRNFIEKYINPFSKNLELKYKSVTNLPIGFHNLRKAAINEKYKLDKSELIVLLYFYLSL

RGAFFDNPEDTKSKEMNKNEIEIFDKNESIKNAEFPIDKIIEFYKISGKIRSTINLKFGHQDYLKEIKQVFEKQNIDFMNYEK

FAMEEKSFFSRIRNYSEGPGNEKSFSKYGLYANENGNPELIINEKGQKIYTKIFKTLWESKIGKCSYDKKLYRAPKNSFSAKV

FDITNKLTDWKHKNEYISERLKRKILLSRFLNKDSKSAVEKILKEENIKFENLSEIAYNKDDNKINLPIINAYHSLTTIFKKH

LINFENYLISNENDLSKLMSFYKQQSEKLFVPNEKGSYEINQNNNVLHIFDAISNILNKFSTIQDRIRILEGYFEFSNLKKDV

KSSEIYSEIAKLREFSGTSSLSFGAYYKFIPNLISEGSKNYSTISYEEKALQNQKNNFSHSNLFEKTWVEDLIASPTVKRSLR

QTMNLLKEIFKYSEKNNLEIEKIVVEVTRSSNNKHERKKIEGINKYRKEKYEELKKVYDLPNENTTLLKKLWLLRQQQGYDAY

SLRKIEANDVINKPWNYDIDHIVPRSISFDDSFSNLVIVNKLDNAKKSNDLSAKQFIEKIYGIEKLKEAKENWGNWYLRNANG

KAFNDKGKFIKLYTIDNLDEFDNSDFINRNLSDTSYITNALVNHLTFSNSKYKYSVVSVNGKQTSNLRNQIAFVGIKNNKETE

REWKRPEGFKSINSNDFLIREEGKNDVKDDVLIKDRSFNGHHAEDAYFITIISQYFRSFKRIERLNVNYRKETRELDDLEKNN

IKFKEKASFDNFLLINALDELNEKLNQMRFSRMVITKKNTQLFNETLYSGKYDKGKNTIKKVEKLNLLDNRTDKIKKIEEFFD

EDKLKENELTKLHIFNHDKNLYETLKIIWNEVKIEIKNKNLNEKNYFKYFVNKKLQEGKISFNEWVPILDNDFKIIRKIRYIK

FSSEEKETDEIIFSQSNFLKIDQRQNFSFHNTLYWVQIWVYKNQKDQYCFISIDARNSKFEKDEIKINYEKLKTQKEKLQIIN

EEPILKINKGDLFENEEKELFYIVGRDEKPQKLEIKYILGKKIKDQKQIQKPVKKYFPNWKKVNLTYMGEIFKK

SEQ ID NO: 55

MDNKNYRIGIDVGLNSIGFCAVEVDQHDTPLGFLNLSVYRHDAGIDPNGKKTNTTRLAMSGVARRTRRLFRKRKRRLAALDRF

IEAQGWTLPDHADYKDPYTPWLVRAELAQTPIRDENDLHEKLAIAVRHIARHRGWRSPWVPVRSLHVEQPPSDQYLALKERVE

AKTLLQMPEGATPAEMVVALDLSVDVNLRPKNREKTDTRPENKKPGFLGGKLMQSDNANELRKIAKIQGLDDALLRELIELVF

AADSPKGASGELVGYDVLPGQHGKRRAEKAHPAFQRYRIASIVSNLRIRHLGSGADERLDVETQKRVFEYLLNAKPTADITWS

DVAEEIGVERNLLMGTATQTADGERASAKPPVDVTNVAFATCKIKPLKEWWLNADYEARCVMVSALSHAEKLTEGTAAEVEVA

EFLQNLSDEDNEKLDSFSLPIGRAAYSVDSLERLTKRMIENGEDLFEARVNEFGVSEDWRPPAEPIGARVGNPAVDRVLKAVN

RYLMAAEAEWGAPLSVNIEHVREGFISKRQAVEIDRENQKRYQRNQAVRSQIADHINATSGVRGSDVTRYLAIQRQNGECLYC

GTAITFVNSEMDHIVPRAGLGSTNTRDNLVATCERCNKSKSNKPFAVWAAECGIPGVSVAEALKRVDFWIADGFASSKEHREL

QKGVKDRLKRKVSDPEIDNRSMESVAWMARELAHRVQYYFDEKHTGTKVRVFRGSLTSAARKASGFESRVNFIGGNGKTRLDR

RHHAMDAATVAMLRNSVAKTLVLRGNIRASERAIGAAETWKSFRGENVADRQIFESWSENMRVLVEKFNLALYNDEVSIFSSL

RLQLGNGKAHDDTITKLQMHKVGDAWSLTEIDRASTPALWCALTRQPDFTWKDGLPANEDRTIIVNGTHYGPLDKVGIFKAA

ASLLVRGGSVDIGSAIHHARIYRIAGKKPTYGMVRVFAPDLLRYRNEDLFNVELPPQSVSMRYAEPKVREAINEGKAEYLGWL

VVGDELLLDLSSETSGQIAELQQDFPGTTHWTVAGFFSPSRLRLRPVYLAQEGLGEDVSEGSKSIIAGQGWRPAVNKVFGSAM

PEVIRRDGLGRKRRFSYSGLPVSWQG

-continued

SEQ ID NO: 56

MRLGLDIGTSSIGWWLYETDGAGSDARITGVVDGGVRIFSDGRDPKSGASLAVDRRAARAMRRRDRYLRRRATLMKVLAETG

LMPADPAEAKALEALDPFALRAAGLDEPLPLPHLGRALFHLNQRRGFKSNRKTDRGDNESGKIKDATARLDMEMMANGARTYG

EFLHKRRQKATDPRHVPSVRTRLSIANRGGPDGKEEAGYDFYPDRRHLEEEFHKLWAAQGAHHPELTETLRDLLFEKIFFQRP

LKEPEVGLCLFSGHHGVPPKDPRLPKAHPLTQRRVLYETVNQLRVTADGREARPLTREERDQVIHALDNKKPTKSLSSMVLKL

PALAKVLKLRDGERFTLETGVRDAIACDPLRASPAHPDRFGPRWSILDADAQWEVISRIRRVQSDAEHAALVDWLTEAHGLDR

AHAEATAHAPLPDGYGRLGLTATTRILYQLTADVVTYADAVKACGWHHSDGRTGECFDRLPYYGEVLERHVIPGSYHPDDDDI

TRFGRITNPTVHIGLNQLRRLVNRIIETHGKPHQIVVELARDLKKSEEQKRADIKRIRDTTEAAKKRSEKLEELEIEDNGRNR

MLLRLWEDLNPDDAMRRFCPYTGTRISAAMIFDGSCDVDHILPYSRTLDDSFPNRTLCLREANRQKRNQTPWQAWGDTPHWHA

IAANLKNLPENKRWRFAPDAMTRFEGENGFLDRALKDTQYLARISRSYLDTLFTKGGHVWVPGRFTEMLRRHWGLNSLLSDA

GRGAVKAKNRTDHRHHAIDAAVIAATDPGLLNRISRAAGQGEAAGQSAELIARDTPPPWEGFRDDLRVRLDRIIVSHRADHGR

IDHAARKQGRDSTAGQLHQETAYSIVDDIHVASRTDLLSLKPAQLLDEPGRSGQVRDPQLRKALRVATGGKTGKDFENALRYF

ASKPGPYQAIRRVRIIKPLQAQARVPVPAQDPIKAYQGGSNHLFEIWRLPDGEIEAQVITSFEAHTLEGEKRPHPAAKRLLRV

HKGDMVALERDGRRVVGHVQKMDIANGLFIVPHNEANADTRNNDKSDPFKWIQIGARPAIASGIRRVSVDEIGRLRDGGTRPI

SEQ ID NO: 57

MLHCIAVIRVPPSEEPGFFETHADSCALCHHGCMTYAANDKAIRYRVGIDVGLRSIGFCAVEVDDEDHPIRILNSVVHVHDAG

TGGPGETESLRKRSGVAARARRRGRAEKQRLKKLDVLLEELGWGVSSNELLDSHAPWHIRKRLVSEYIEDETERRQCLSVAMA

HIARHRGWRNSFSKVDTLLLEQAPSDRMQGLKERVEDRTGLQFSEEVTQGELVATLLEHDGDVTIRGFVRKGGKATKVHGVLE

GKYMQSDLVAELRQICRTQRVSETTFEKLVLSIFHSKEPAPSAARQRERVGLDELQLALDPAAKQPRAERAHPAFQKFKVVAT

LANMRIREQSAGERSLTSEELNRVARYLLNHTESESPTWDDVARKLEVPRHRLRGSSRASLETGGGLTYPPVDDTTVRVMSAE

VDWLADWWDCANDESRGHMIDAISNGCGSEPDDVEDEEVNELISSATAEDMLKLELLAKKLPSGRVAYSLKTLREVTAAILET

GDDLSQAITRLYGVDPGWVPTPAPIEAPVGNPSVDRVLKQVARWLKFASKRWGVPQTVNIEHTREGLKSASLLEEERERWERF

EARREIRQKEMYKRLGISGPFRRSDQVRYEILDLQDCACLYCGNEINFQTFEVDHIIPRVDASSDSRRTNLAAVCHSCNSAKG

GLAFGQWVKRGDCPSGVSLENAIKRVSWSKDRLGLTEKAMGKRKSEVISRLKTEMPYEEFDGRSMESVAWMAIELKKRIEGY

FNSDRPEGCAAVQVNAYSGRLTACARRAAHVDKRVRLIRLKGDDGHHKNRFDRRNHAMDALVIALMTPAIARTIAVREDRREA

QQLTRAFESWKNFLGSEERMQDRWESWIGDVEYACDRLNELIDADKIPVTENLRLRNSGKLHADQPESLKKARRGSKRPRPQR

YVLGDALPADVINRVTDPGLWTALVRAPGFDSQLGLPADLNRGLKLRGKRISADFPIDYFPTDSPALAVQGGYVGLEFHHARL

YRIIGPKEKVKYALLRVCAIDLCGIDCDDLFEVELKPSSISMRTADAKLKEAMGNGSAKQIGWLVLGDEIQIDPTKFPKQSIG

KFLKECGPVSSWRVSALDTPSKITLKPRLLSNEPLLKTSRVGGHESDLVVAECVEKIMKKTGWVVEINALCQSGLIRVIRRNA

LGEVRTSPKSGLPISLNLR

SEQ ID NO: 58

MRYRVGLDLGTASVGAAVFSMDEQGNPMELIWHYERLFSEPLVPDMGQLKPKKAARRLARQQRRQIDRRASRLRRIAIVSRRL

GIAPGRNDSGVHGNDVPTLRAMAVNERIELGQLRAVLLRMGKKRGYGGTFKAVRKVGEAGEVASGASRLEEEMVALASVQNKD

SVTVGEYLAARVEHGLPSKLKVAANNEYYAPEYALFRQYLGLPAIKGRPDCLPNMYALRHQIEHEFERIWATQSQFHDVMKDH

GVKEEIRNAIFFQRPLKSPADKVGRCSLQTNLPRAPRAQIAAQNFRIEKQMADLRWGMGRRAEMLNDHQKAVIRELLNQQKEL

SFRKIYKELERAGCPGPEGKGLNMDRAALGGRDDLSGNTTLAAWRKLGLEDRWQELDEVTQIQVINFLADLGSPEQLDTDDWS

CRFMGKNGRPRNFSDEFVAFMNELRMTDGFDRLSKMGFEGGRSSYSIKALKALTEWMIAPHWRETPETHRVDEEAAIRECYPE

SLATPAQGGRQSKLEPPPLTGNEVVDVALRQVRHTINMMIDDLGSVPAQIVVEMAREMKGGVTRRNDIEKQNKRFASERKKAA

QSIEENGKTPTPARILRYQLWIEQGHQCPYCESNISLEQALSGAYTNFEHILPRTLTQIGRKRSELVLAHRECNDEKGNRTPY

QAFGHDDRRWRIVEQRANALPKKSSRKTRLLLLKDFEGEALTDESIDEFADRQLHESSWLAKVTTQWLSSLGSDVYVSRGSLT

AELRRRWGLDTVIPQVRFESGMPVVDEEGAEITPEEFEKFRLQWEGHRVTREMRTDRRPDKIRIDHRHHLVDAIVTALTSRSLY

QQYAKAWKVADEKQRHGRVDVKVELPMPILTIRDIALEAVRSVRISHKPDRYPDGRFFEATAYGIAQRLDERSGEKVDWLVSR

-continued

KSLTDLAPEKKSIDVDKVRANISRIVGEAIRLHISNIFEKRVSKGMTPQQALREPIEFQGNILRKVRCFYSKADDCVRIEHSS

RRGHHYKMLLNDGFAYMEVPCKEGILYGVPNLVRPSEAVGIKRAPESGDFIRFYKGDTVKNIKTGRVYTIKQILGDGGGKLIL

TPVTETKPADLLSAKWGRLKVGGRNIHLLRLCAE

SEQ ID NO: 59

MIGEHVRGGCLFDDHWTPNWGAFRLPNTVRTFTKAENPKDGSSLAEPRRQARGLRRRLRRKTQRLEDLRRLLAKEGVLSLSDL

ETLFRETPAKDPYQLRAEGLDRPLSFPEWVRVLYHITKHRGFQSNRRNPVEDGQERSRQEEEGKLLSGVGENERLLREGGYRT

AGEMLARDPKFQDHRRNRAGDYSHTLSRSLLLEEARRLFQSQRTLGNPHASSNLEEAFLHLVAFQNPFASGEDIRNKAGHCSL

EPDQIRAPRRSASAETFMLLQKTGNLRLIHRRTGEERPLTDKEREQIHLLAWKQEKVIHKTLRRHLEIPEEWLFTGLPYHRSG

DKAEEKLFVHLAGIHEIRKALDKGPDPAVWDTLRSRRDLLDSIADTLTFYKNEDEILPRLESLGLSPENARALAPLSFSGTAH

LSLSALGKLLPHLEEGKSYTQARADAGYAAPPPDRHPKLPPLEEADWRNPVVFRALTQTRKVVNALVRRYGPPWCIHLETARE

LSQPAKVRRRIETEQQANEKKKQQAEREFLDIVGTAPGPGDLLKMRLWREQGGFCPYCEEYLNPTRLAEPGYAEMDHILPYSR

SLDNGWHNRVLVHGKDNRDKGNRTPFEAFGGDTARWDRLVAWVQASHLSAPKKRNLLREDFGEEAERELKDRNLTDTRFITKT

AATLLRDRLTFHPEAPKDPVMTLNGRLTAFLRKQWGLHKNRKNGDLHHALDAAVLAVASRSFVYRLSSHNAAWGELPRGREAE

NGFSLPYPAFRSEVLARLCPTREEILLRLDQGGVGYDEAFRNGLRPVFVSRAPSRRLRGKAHMETLRSPKWKDHPEGPRTASR

IPLKDLNLEKLERMVGKDRDRKLYEALRERLAAFGGNGKKAFVAPFRKPCRSGEGPLVRSLRIFDSGYSGVELRDGGEVYAVA

DHESMVRVDVYAKKNRFYLVPVYVADVARGIVKNRAIVAHKSEEEWDLVDGSFDFRFSLFPGDLVEIEKKDGAYLGYYKSCHR

GDGRLLLDRHDRMPRESDCGTFYVSTRKDVLSMSKYQVDPLGEIRLVGSEKPPFVL

SEQ ID NO: 60

MEKKRKVTLGFDLGIASVGWAIVDSETNQVYKLGSRLFDAPDTNLERRTQRGTRRLLRRRKYRNQKFYNLVKRTEVFGLSSRE

AIENRFRELSIKYPNIIELKTKALSQEVCPDEIAWILHDYLKNRGYFYDEKETKEDFDQQTVESMPSYKLNEFYKKYGYFKGA

LSQPTESEMKDNKDLKEAFFFDFSNKEWLKEINYFFNVQKNILSETFIEEFKKIFSFTRDISKGPGSDNMPSPYGIFGEFGDN

GQGGRYEHIWDKNIGKCSIFTNEQRAPKYLPSALIFNFLNELANIRLYSTDKKNIQPLWKLSSVDKLNILLNFLNLPISEKKK

KLTSTNINDIVKKESIKSIMISVEDIDMIKDEWAGKEPNVYGVGLSGLNIEESAKENKFKFQDLKILNVLINLLDNVGIKFEF

KDRNDIIKNLELLDNLYLFLIYQKESNNKDSSIDLFIAKNESLNIENLKLKLKEFLLGAGNEFENHNSKTHSLSKKAIDEILP

KLLDNNEGWNLEAIKNYDEEIKSQIEDNSSLMAKQDKKYLNDNFLKDAILPPNVKVTFQQAILIFNKIIQKFSKDFEIDKVVI

ELAREMTQDQENDALKGIAKAQKSKKSLVEERLEANNIDKSVFNDKYEKLIYKIFLWISQDFKDPYTGAQISVNEIVNNKVEI

DHIIPYSLCFDDSSANKVLVHKQSNQEKSNSLPYEYIKQGHSGWNWDEFTKYVKRVFVNNVDSILSKKERLKKSENLLTASYD

GYDKLGFLARNLNDTRYATILFRDQLNNYAEHHLIDNKKMFKVIAMNGAVTSFIRKNMSYDNKLRLKDRSDFSHHAYDAAIIA

LFSNKTKTLYNLIDPSLNGIISKRSEGYWVIEDRYTGEIKELKKEDWTSIKNNVQARKIAKEIEEYLIDLDDEVFFSRKTKRK

TNRQLYNETIYGIATKTDEDGITNYYKKEKFSILDDKDIYLRLLREREKFVINQSNPEVIDQIIEIIESYGKENNIPSRDEAI

NIKYTKNKINYNLYLKQYMRSLTKSLDQFSEEFINQMIANKTFVLYNPTKNTTRKIKFLRLVNDVKINDIRKNQVINKFNGKN

NEPKAFYENINSLGAIVFKNSANNFKTLSINTQIAIFGDKNWDIEDFKTYNMEKIEKYKEIYGIDKTYNFHSFIFPGTILLDK

QNKEFYYISSIQTVRDIIEIKFLNKIEFKDENKNQDTSKTPKRLMFGIKSIMNNYEQVDISPFGINKKIFE

SEQ ID NO: 61

MGYRIGLDVGITSTGYAVLKTDKNGLPYKILTLDSVIYPRAENPQTGASLAEPRRIKRGLRRRTRRTKFRKQRTQQLFIHSGL

LSKPEIEQILATPQAKYSVYELRVAGLDRRLTNSELFRVLYFFIGHRGFKSNRKAELNPENEADKKQMGQLLNSIEEIRKAIA

EKGYRTVGELYLKDPKYNDHKRNKGYIDGYLSTPNRQMLVDEIKQILDKQRELGNEKLTDEFYATYLLGDENRAGIFQAQRDF

DEGPGAGPYAGDQIKKMVGKDIFEPTEDRAAKATYTFQYFNLLQKMTSLNYQNTTGDTWHTLNGLDRQAIIDAVFAKAEKPTK

TYKPTDFGELRKLLKLPDDARFNLVNYGSLQTQKEIETVEKKTRFVDFKAYHDLVKVLPEEMWQSRQLLDHIGTALTLYSSDK

RRRRYFAEELNLPAELIEKLLPLNFSKFGHLSIKSMQNIIPYLEMGQVYSEATTNTGYDFRKKQISKDTIREEITNPVVRRAV

TKTIKIVEQIIRRYGKPDGINIELARELGRNFKERGDIQKRQDKNRQTNDKIAAELTELGIPVNGQNIIRYKLHKEQNGVDPY

TGDQIPFERAFSEGYEVDHIIPYSISWDDSYTNKVLTSAKCNREKGNRIPMVYLANNEQRLNALTNIADNIIRNSRKRQKLLK

-continued

QKLSDEELKDWKQRNINDTRFITRVLYNYFRQAIEFNPELEKKQRVLPLNGEVTSKIRSRWGFLKVREDGDLHHAIDATVIAA
ITPKFIQQVTKYSQHQEVKNNQALWHDAEIKDAEYAAEAQRMDADLFNKIFNGFPLPWPEFLDELLARISDNPVEMMKSRSWN
TYTPIEIAKLKPVFVVRLANHKISGPAHLDTIRSAKLFDEKGIVLSRVSITKLKINKKGQVATGDGIYDPENSNNGDKVVYSA
IRQALEAHNGSGELAFPDGYLEYVDHGTKKLVRKVRVAKKVSLPVRLKNKAAADNGSMVRIDVFNTGKKFVFVPIYIKDTVEQ
VLPNKAIARGKSLWYQITESDQFCFSLYPGDMVHIESKTGIKPKYSNKENNTSVVPIKNFYGYFDGADIATASILVRAHDSSY
TARSIGIAGLLKFEKYQVDYFGRYHKVHEKKRQLFVKRDE

SEQ ID NO: 62

MQKNINTKQNHIYIKQAQKIKEKLGDKPYRIGLDLGVGSIGFAIVSMEENDGNVLLPKEIIMVGSRIFKASAGAADRKLSRGQ
RNNHRHTRERMRYLWKVLAEQKLALPVPADLDRKENSSEGETSAKRFLGDVLQKDIYELRVKSLDERLSLQELGYVLYHIAGH
RGSSAIRTFENDSEEAQKENTENKKIAGNIKRLMAKKNYRTYGEYLYKEFFENKEKHKREKISNAANNHKFSPTRDLVIKEAE
AILKKQAGKDGFHKELTEEYIEKLTKAIGYESEKLIPESGFCPYLKDEKRLPASHKLNEERRLWETLNNARYSDPIVDIVTGE
ITGYYEKQFTKEQKQKLFDYLLTGSELTPAQTKKLLGLKNTNFEDIILQGRDKKAQKIKGYKLIKLESMPFWARLSEAQQDSF
LYDWNSCPDEKLLTEKLSNEYHLTEEEIDNAFNEIVLSSSYAPLGKSAMLIILEKIKNDLSYTEAVEEALKEGKLTKEKQAIK
DRLPYYGAVLQESTQKIIAKGFSPQFKDKGYKTPHTNKYELEYGRIANPVVHQTLNELRKLVNEIIDILGKKPCEIGLETARE
LKKSAEDRSKLSREQNDNESNRNRIYEIYIRPQQQVIITRRENPRNYILKFELLEEQKSQCPFCGGQISPNDIINNQADIEHL
FPIAESEDNGRNNLVISHSACNADKAKRSPWAAFASAAKDSKYDYNRILSNVKENIPHKAWRFNQGAFEKFIENKPMAARFKT
DNSYISKVAHKYLACLFEKPNIICVKGSLTAQLRMAWGLQGLMIPFAKQLITEKESESFNKDVNSNKKIRLDNRHHALDAIVI
AYASRGYGNLLNKMAGKDYKINYSERNWLSKILLPPNNIVWENIDADLESFESSVKTALKNAFISVKHDHSDNGELVKGTMYK
IFYSERGYTLTTYKKLSALKLTDPQKKKTPKDFLETALLKFGRESEMKNEKIKSAIENNKRLFDVIQDNLEKAKKLLEEENE
KSKAEGKKEKNINDASIYQKAISLSGDKYVQLSKKEPGKFFAISKPTPTTTGYGYDTGDSLCVDLYYDNKGKLCGEIIRKIDA
QQKNPLKYKEQGFTLFERIYGGDILEVDFDIHSDKNSFRNNTGSAPENRVFIKVGTFTEITNNNIQIWFGNIIKSTGGQDDSF
TINSMQQYNPRKLILSSCGFIKYRSPILKNKEG

SEQ ID NO: 63

MAAFKPNPINYILGLDIGIASVGWAMVEIDEDENPICLIDLGVRVFERAEVPKTGDSLAMARRLARSVRRLTRRRAHRLLRAR
RLLKREGVLQAADFDENGLIKSLPNTPWQLRAAALDRKLTPLEWSAVLLHLIKHRGYLSQRKNEGETADKELGALLKGVADNA
HALQTGDFRTPAELALNKFEKESGHIRNQRGDYSHTFSRKDLQAELILLFEKQKEFGNPHVSGGLKEGIETLLMTQRPALSGD
AVQKMLGHCTFEPAEPKAAKNTYTAERFIWLTKLNNLRILEQGSERPLTDTERATLMDEPYRKSKLTYAQARKLLGLEDTAFF
KGLRYGKDNAEASTLMEMKAYHAISRALEKEGLKDKKSPLNLSPELQDEIGTAFSLFKTDEDITGRLKDRIQPEILEALLKHI
SFDKFVQISLKALRRIVPLMEQGKRYDEACAEIYGDHYGKKNTEEKIYLPPIFADEIRNPVVLRALSQARKVINGVVRRYGSP
ARIHIETAREVGKSFKDRKEIEKRQEENRKDREKAAAKFREYFPNFVGEPKSKDILKLRLYEQQHGKCLYSGKEINLGRLNEK
GYVEIDHALPFSRTWDDSFNNKVLVLGSENQNKGNQTPYEYFNGKDNSREWQEFKARVETSRFPRSKKQRILLQKFDEDGFKE
RNLNDTRYVNRFLCQFVADRMRLTGKGKKRVFASNGQITNLLRGFWGLRKVRAENDRHHALDAVVVACSTVAMQQKITRFVRY
KEMNAFDGKTIDKETGEVLHQKTHFPQPWEFFAQEVMIRVFGKPDGKPEFEEADTPEKLRTLLAEKLSSRPEAVHEYVTPLFV
SRAPNRKMSGQGHMETVKSAKRLDEGVSVLRVPLTQLKLKDLEKMVNREREPKLYEALKARLEAHKDDPAKAFAEPFYKYDKA
GNRTQQVKAVRVEQVQKTGVWVRNHNGIADNATMVRVDVFEKGDKYYLVPIYSWQVAKGILPDRAVVQGKDEEDWQLIDDSFN
FKFSLHPNDLVEVITKKARMFGYFASCHRGTGNINIRIHDLDHKIGKNGILEGIGVKTALSFQKYQIDELGKEIRPCRLKKRP
PVR

SEQ ID NO: 64

MQTTNLSYILGLDLGIASVGWAVVEINENEDPIGLIDVGVRIFERAEVPKTGESLALSRRLARSTRRLIRRRAHRLLLAKRFL
KREGILSTIDLEKGLPNQAWELRVAGLERRLSAIEWGAVLLHLIKHRGYLSKRKNESQTNNKELGALLSGVAQNHQLLQSDDY
RTPAELALKKFAKEEGHIRNQRGAYTHTFNRLDLLAELNLLFAQQHQFGNPHCKEHQQYMTELLMWQKPALSGEAILKMLGK
CTHEKNEFKAAKHTYSAERFVWLTKLNNLRILEDGAERALNEEERQLLINHPYEKSKLTYAQVRKLLGLSEQAIFKHLRYSKE

-continued

NAESATFMELKAWHAIRKALENQGLKDTWQDLAKKPDLLDEIGTAFSLYKTDEDIQQYLTNKVPNSVINALLVSLNFDKFIEL

SLKSLRKILPLMEQGKRYDQACREIYGHHYGEANQKTSQLLPAIPAQEIRNPVVLRTLSQARKVINAIIRQYGSPARVHIETG

RELGKSFKERREIQKQQEDNRTKRESAVQKFKELFSDFSSEPKSKDILKFRLYEQQHGKCLYSGKEINIHRLNEKGYVEIDHA

LPFSRTWDDSFNNKVLVLASENQNKGNQTPYEWLQGKINSERWKNFVALVLGSQCSAAKKQRLLTQVIDDNKFIDRNLNDTRY

IARFLSNYIQENLLLVGKNKKNVFTPNGQITALLRSRWGLIKARENNNRHHALDAIVVACATPSMQQKITRFIRFKEVHPYKI

ENRYEMVDQESGEIISPHFPEPWAYFRQEVNIRVFDNHPDTVLKEMLPDRPQANHQFVQPLFVSRAPTRKMSGQGHMETIKSA

KRLAEGISVLRIPLTQLKPNLLENMVNKEREPALYAGLKARLAEFNQDPAKAFATPFYKQGGQQVKAIRVEQVQKSGVLVREN

NGVADNASIVRTDVFIKNNKFFLVPIYTWQVAKGILPNKAIVAHKNEDEWEEMDEGAKFKFSLFPNDLVELKTKKEYFFGYYI

GLDRATGNISLKEHDGEISKGKDGVYRVGVKLALSFEKYQVDELGKNRQICRPQQRQPVR

SEQ ID NO: 65

MGIRFAFDLGTNSIGWAVWRTGPGVFGEDTAASLDGSGVLIFKDGRNPKDGQSLATMRRVPRQSRKRRDRFVLRRRDLLAALR

KAGLFPVDVEEGRRLAATDPYHLRAKALDESLTPHEMGRVIFHLNQRRGFRSNRKADRQDREKGKIAEGSKRLAETLAATNCR

TLGEFLWSRHRGTPRTRSPTRIRMEGEGAKALYAFYPTREMVRAEFERLWTAQSRFAPDLLTPERHEEIAGILFRQRDLAPPK

IGCCTFEPSERRLPRALPSVEARGIYERLAHLRITTGPVSDRGLTRPERDVLASALLAGKSLTFKAVRKTLKILPHALVNFEE

AGEKGLDGALTAKLLSKPDHYGAAWHGLSFAEKDTFVGKLLDEADEERLIRRLVTENRLSEDAARRCASIPLADGYGRLGRTA

NTEILAALVEETDETGTVVTYAEAVRRAGERTGRNWHHSDERDGVILDRLPYYGEILQRHVVPGSGEPEEKNEAARWGRLANP

TVHIGLNQLRKVVNRLIAAHGRPDQIVVELARELKLNREQKERLDRENRKNREENERRTAILAEHGQRDTAENKIRLRLFEEQ

ARANAGIALCPYTGRAIGIAELFTSEVEIDHILPVSLTLDDSLANRVLCRREANREKRRQTPFQAFGATPAWNDIVARAAKLP

PNKRWRFDPAALERFEREGGFLGRQLNETKYLSRLAKIYLGKICDPDRVYVTPGTLTGLLRARWGLNSILSDSNFKNRSDHRH

HAVDAVVIGVLTRGMIQRIAHDAARAEDQDLDRVFRDVPVPFEDFRDHVRERVSTITVAVKPEHGKGGALHEDTSYGLVPDTD

PNAALGNLVVRKPIRSLTAGEVDRVRDRALRARLGALAAPFRDESGRVRDAKGLAQALEAFGAENGIRRVRILKPDASVVTIA

DRRTGVPYRAVAPGENHHVDIVQMRDGSWRGFAASVFEVNRPGWRPEWEVKKLGGKLVMRLHKGDMVELSDKDGQRRVKVVQQ

IEISANRVRLSPHNDGGKLQDRHADADDPFRWDLATIPLLKDRGCVAVRVDPIGVVTLRRSNV

SEQ ID NO: 66

MMEVFMGRLVLGLDIGITSVGFGIIDLDESEIVDYGVRLFKEGTAAENETRRTKRGGRRLKRRRVTRREDMLHLLKQAGIIST

SFHPLNNPYDVRVKGLNERLNGEELATALLHLCKHRGSSVETIEDDEAKAKEAGETKKVLSMNDQLLKSGKYVCEIQKERLRT

NGHIRGHENNFKTRAYVDEAFQILSHQDLSNELKSAIITIISRKRMYYDGPGGPLSPTPYGRYTYFGQKEPIDLIEKMRGKCS

LFPNEPRAPKLAYSAELFNLLNDLNNLSIEGEKLTSEQKAMILKIVHEKGKITPKQLAKEVGVSLEQIRGFRIDTKGSPLLSE

LTGYKMIREVLEKSNDEHLEDHVFYDEIAEILTKTKDIEGRKKQISELSSDLNEESVHQLAGLTKFTAYHSLSFKALRLINEE

MLKTELNQMQSITLFGLKQNNELSVKGMKNIQADDTAILSPVAKRAQRETFKVVNRLREIYGEFDSIVVEMAREKNSEEQRKA

IRERQKFFEMRNKQVADIIGDDRKINAKLREKLVLYQEQDGKTAYSLEPIDLKLLIDDPNAYEVDHIIPISISLDDSITNKVL

VTHRENQEKGNLTPISAFVKGRFTKGSLAQYKAYCLKLKEKNIKTNKGYRKKVEQYLLNENDIYKYDIQKEFINRNLVDTSYA

SRVVLNTLTTYFKQNEIPTKVFTVKGSLTNAFRRKINLKKDRDEDYGHHAIDALIIASMPKMRLLSTIFSRYKIEDIYDESTG

EVFSSGDDSMYYDDRYFAFIASLKAIKVRKFSHKIDTKPNRSVADETIYSTRVIDGKEKVVKKYKDIYDPKFTALAEDILNNA

YQEKYLMALHDPQTFDQIVKVVNYYFEEMSKSEKYFTKDKKGRIKISGMNPLSLYRDEHGMLKKYSKKGDGPAITQMKYFDGV

LGNHIDISAHYQVRDKKVVLQQISPYRTDFYYSKENGYKFVTIRYKDVRWSEKKKKYVIDQQDYAMKKAEKKIDDTYEFQFSM

HRDELIGITKAEGEALIYPDETWHNFNFFFHAGETPEILKFTATNNDKSNKIEVKPIHCYCKMRLMPTISKKIVRIDKYATDV

VGNLYKVKKNTLKFEFD

SEQ ID NO: 67

MKKILGVDLGITSFGYAILQETGKDLYRCLDNSVVMRNNPYDEKSGESSQSIRSTQKSMRRLIEKRKKRIRCVAQTMERYGIL

DYSETMKINDPKNNPIKNRWQLRAVDAWKRPLSPQELFAIFAHMAKHRGYKSIATEDLIYELELELGLNDPEKESEKKADERR

QVYNALRHLEELRKKYGGETIAQTIHRAVEAGDLRSYRNHDDYEKMIRREDIEEEIEKVLLRQAELGALGLPEEQVSELIDEL

-continued

KACITDQEMPTIDESLFGKCTFYKDELAAPAYSYLYDLYRLYKKLADLNIDGYEVTQEDREKVIEWVEKKIAQGKNLKKITHK

DLRKILGLAPEQKIFGVEDERIVKGKKEPRTFVPFFFLADIAKFKELFASIQKHPDALQIFRELAEIILQRSKTPQEALDRLRA

LMAGKGIDTDDRELLELFKNKRSGTRELSHRYILEALPLFLEGYDEKEVQRILGFDDREDYSRYPKSLRHLHLREGNLFEKEE

NPINNHAVKSLASWALGLIADLSWRYGPFDEIILETTRDALPEKIRKEIDKAMREREKALDKIIGKYKKEFPSIDKRLARKIQ

LWERQKGLDLYSGKVINLSQLLDGSADIEHIVPQSLGGLSTDYNTIVTLKSVNAAKGNRLPGDWLAGNPDYRERIGMLSEKGL

IDWKKRKNLLAQSLDEIYTENTHSKGIRATSYLEALVAQVLKRYYPFPDPELRKNGIGVRMIPGKVTSKTRSLLGIKSKSRET

NFHHAEDALILSTLTRGWQNRLHRMLRDNYGKSEAELKELWKKYMPHIEGLTLADYIDEAFRRFMSKGEESLFYRDMFDTIRS

ISYWVDKKPLSASSHKETVYSSRHEVPTLRKNILEAFDSLNVIKDRHKLTTEEFMKRYDKEIRQKLWLHRIGNTNDESYRAVE

ERATQIAQILTRYQLMDAQNDKEIDEKFQQALKELITSPIEVTGKLLRKMRFVYDKLNAMQIDRGLVETDKNMLGIHISKGPN

EKLIFRRMDVNNAHELQKERSGILCYLNEMLFIFNKKGLIHYGCLRSYLEKGQGSKYIALFNPRFPANPKAQPSKFTSDSKIK

QVGIGSATGIIKAHLDLDGHVRSYEVFGTLPEGSIEWFKEESGYGRVEDDPHH

SEQ ID NO: 68

MRPIEPWILGLDIGTDSLGWAVFSCEEKGPPTAKELLGGGVRLFDSGRDAKDHTSRQAERGAFRRARRQTRTWPWRRDRLIAL

FQAAGLTPPAAETRQIALALRREAVSRPLAPDALWAALLHLAHHRGFRSNRIDKRERAAAKALAKAKPAKATAKATAPAKEAD

DEAGFWEGAEAALRQRMAASGAPTVGALLADDLDRGQPVRMRYNQSDRDGVVAPTRALIAEELAEIVARQSSAYPGLDWPAVT

RLVLDQRPLRSKGAGPCAFLPGEDRALRALPTVQDFIIRQTLANLRLPSTSADEPRPLTDEEHAKALALLSTARFVEWPALRR

ALGLKRGVKFTAETERNGAKQAARGTAGNLTEAILAPLIPGWSGWDLDRKDRVFSDLWAARQDRSALLALIGDPRGPTRVTED

ETAEAVADAIQIVLPTGRASLSAKAARAIAQAMAPGIGYDEAVTLALGLHHSHRPRQERLARLPYYAAALPDVGLDGDPVGPP

PAEDDGAAAEAYYGRIGNISVHIALNETRKIVNALLHRHGPILRLVMVETTRELKAGADERKRMIAEQAERERENAEIDVELR

KSDRWMANARERRQRVRLARRQNNLCPYTSTPIGHADLLGDAYDIDHVIPLARGGRDSLDNMVLCQSDANKTKGDKTPWEAFH

DKPGWIAQRDDFLARLDPQTAKALAWRFADDAGERVARKSAEDEDQGFLPRQLTDTGYIARVALRYLSLVTNEPNAVVATNGR

LTGLLRLAWDITPGPAPRDLLPTPRDALRDDTAARRFLDGLTPPPLAKAVEGAVQARLAALGRSRVADAGLADALGLTLASLG

GGGKNRADHRHHFIDAAMIAVTTRGLINQINQASGAGRILDLRKWPRTNFEPPYPTFRAEVMKQWDHIHPSIRPAHRDGGSLH

AATVFGVRNRPDARVLVQRKPVEKLFLDANAKPLPADKIAEIIDGFASPRMAKRFKALLARYQAAHPEVPPALAALAVARDPA

FGPRGMTANTVIAGRSDGDGEDAGLITPFRANPKAAVRTMGNAVYEVWEIQVKGRPRWTHRVLTRFDRTQPAPPPPPENARLV

MRLRRGDLVYWPLESGDRLFLVKKMAVDGRLALWPARLATGKATALYAQLSCPNINLNGDQGYCVQSAEGIRKEKIRTTSCTA

LGRLRLSKKAT

SEQ ID NO: 69

MKYTLGLDVGIASVGWAVIDKDNNKIIDLGVRCFDKAEESKTGESLATARRIARGMRRRISRRSQRLRLVKKLFVQYEIIKDS

SEFNRIFDTSRDGWKDPWELRYNALSRILKPYELVQVLTHITKRRGFKSNRKEDLSTTKEGVVITSIKNNSEMLRTKNYRTIG

EMIFMETPENSNKRNKVDEYIHTIAREDLLNEIKYIFSIQRKLGSPFVTEKLEHDFLNIWEFQRPFASGDSILSKVGKCTLLK

EELRAPTSCYTSEYFGLLQSINNLVLVEDNNTLTLNNDQRAKIIEYAHFKNEIKYSEIRKLLDIEPEILFKAHNLTHKNPSGN

NESKKFYEMKSYHKLKSTLPTDIWGKLHSNKESLDNLFYCLTVYKNDNEIKDYLQANNLDYLIEYIAKLPTFNKFKHLSLVAM

KRIIPFMEKGYKYSDACNMAELDFTGSSKLEKCNKLTVEPIIENVTNPVVIRALTQARKVINAIIQKYGLPYMVNIELAREAG

MTRQDRDNLKKEHENNRKAREKISDLIRQNGRVASGLDILKWRLWEDQGGRCAYSGKPIPVCDLLNDSLTQIDHIYPYSRSMD

DSYMNKVLVLTDENQNKRSYTPYEVWGSTEKWEDFEARIYSMHLPQSKEKRLLNRNFITKDLDSFISRNLNDTRYISRFLKNY

IESYLQFSNDSPKSCVVCVNGQCTAQLRSRWGLNKNREESDLHHALDAAVIACADRKIIKEITNYYNERENHNYKVKYPLPWH

SFRQDLMETLAGVFISRAPRRKITGPAHDETIRSPKHFNKGLTSVKIPLTTVTLEKLETMVKNTKGGISDKAVYNVLKNRLIE

HNNKPLKAFAEKIYKPLKNGTNGAIIRSRVETPSYTGVFRNEGKGISDNSLMVRVDVFKKKDKYYLVPIYVAHMIKKELPSK

AIVPLKPESQWELIDSTHEFLFSLYQNDYLVIKTKKGITEGYYRSCHRGTGSLSLMPHFANNKNVKIDIGVRTAISIEKYNVD

ILGNKSIVKGEPRRGMEKYNSFKSN

-continued

SEQ ID NO: 70
MIRTLGIDIGIASIGWAVIEGEYTDKGLENKEIVASGVRVFTKAENPKNKESLALPRTLARSARRRNARKKGRIQQVKHYLSK
ALGLDLECFVQGEKLATLFQTSKDFLSPWELRERALYRVLDKEELARVILHIAKRRGYDDITYGVEDNDSGKIKKAIAENSKR
IKEEQCKTIGEMMYKLYFQKSLNVRNKKESYNRCVGRSELREELKTIFQIQQELKSPWVNEELIYKLLGNPDAQSKQEREGLI
FYQRPLKGFGDKIGKCSHIKKGENSPYRACKHAPSAEEFVALTKSINFLKNLTNRHGLCFSQEDMCVYLGKILQEAQKNEKGL
TYSKLKLLLDLPSDFEFLGLDYSGKNPEKAVFLSLPSTFKLNKITQDRKTQDKIANILGANKDWEAILKELESLQLSKEQIQT
IKDAKLNFSKHINLSLEALYHLLPLMNEGKRYDEGVEILQERGIFSKPQPKNRQLLPPLSELAKEESYFDIPNPVLRRALSEF
RKVVNALLEKYGGFHYFHIELTRDVCKAKSARMQLEKINKKNKSENDAASQLLEVLGLPNTYNNRLKCKLWKQQEEYCLYSGE
KITIDHLKDQRALQIDHAFPLSRSLDDSQSNKVLCLTSSNQEKSNKTPYEWLGSDEKKWDMYVGRVYSSNFSPSKKRKLTQKN
FKERNEEDFLARNLVDTGYIGRVTKEYIKHSLSFLPLPDGKKEHIRIISGSMTSTMRSFWGVQEKNRDHHLHHAQDAIIIACI
EPSMIQKYTTYLKDKETHRLKSHQKAQILREGDHKLSLRWPMSNFKDKIQESIQNIIPSHHVSHKVTGELHQETVRTKEFYYQ
AFGGEEGVKKALKFGKIREINQGIVDNGAMVRVDIFKSKDKGKFYAVPIYTYDFAIGKLPNKAIVQGKKNGIIKDWLEMDENY
EFCFSLFKNDCIKIQTKEMQEAVLAIYKSTNSAKATIELEHLSKYALKNEDEEKMFTDTDKEKNKTMTRESCGIQGLKVFQKV
KLSVLGEVLEHKPRNRQNIALKTTPKHV

SEQ ID NO: 71
MKYSIGLDIGIASVGWSVINKDKERIEDMGVRIFQKAENPKDGSSLASSRREKRGSRRRNRRKKHRLDRIKNILCESGLVKKN
EIEKIYKNAYLKSPWELRAKSLEAKISNKEIAQILLHIAKRRGFKSFRKTDRNADDTGKLLSGIQENKKIMEEKGYLTIGDMV
AKDPKFNTHVRNKAGSYLFSFSRKLLEDEVRKIQAKQKELGNTHFTDDVLEKYIEVFNSQRNFDEGPSKPSPYYSEIGQIAKM
IGNCTFESSEKRTAKNTWSGERFVFLQKLNNFRIVGLSGKRPLTEEERDIVEKEVYLKKEVRYEKLRKILYLKEEERFGDLNY
SKDEKQDKKTEKTKFISLIGNYTIKKLNLSEKLKSEIEEDKSKLDKIIEILTFNKSDKTIESNLKKLELSREDIEILLSEEFS
GTLNLSLKAIKKILPYLEKGLSYNEACEKADYDYKNNGIKFKRGELLPVVDKDLIANPVVLRAISQTRKVVNAIIRKYGTPHT
IHVEVARDLAKSYDDRQTIIKENKKRELENEKTKKFISEEFGIKNVKGKLLLKYRLYQEQEGRCAYSRKELSLSEVILDESMT
DIDHIIPYSRSMDDSYSNKVLVLSGENRKKSNLLPKEYFDRQGRDWDTFVLNVKAMKIHPRKKSNLLKEKFTREDNKDWKSRA
LNDTRYISRFVANYLENALEYRDDSPKKRVFMIPGQLTAQLRARWRLNKVRENGDLHHALDAAVVAVTDQKAINNISNISRYK
ELKNCKDVIPSIEYHADEETGEVYFEEVKDTRFPMPWSGFDLELQKRLESENPREEFYNLLSDKRYLGWFNYEEGFIEKLRPV
FVSRMPNRGVKGQAHQETIRSSKKISNQIAVSKKPLNSIKLKDLEKMQGRDTDRKLYEALKNRLEEYDDKPEKAFAEPFYKPT
NSGKRGPLVRGIKVEEKQNVGVYVNGGQASNGSMVRIDVFRKNGKFYTVPIYVHQTLLKELPNRAINGKPYKDWDLIDGSFEF
LYSFYPNDLIEIEFGKSKSIKNDNKLTKTEIPEVNLSEVLGYYRGMDTSTGAATIDTQDGKIQMRIGIKTVKNIKKYQVDVLG
NVYKVKREKRQTF

SEQ ID NO: 72
MSKKVSRRYEEQAQEICQRLGSRPYSIGLDLGVGSIGVAVAAYDPIKKQPSDLVFVSSRIFIPSTGAAERRQKRGQRNSLRHR
ANRLKFLWKLLAERNLMLSYSEQDVPDPARLRFEDAVVRANPYELRLKGLNEQLTLSELGYALYHIANHRGSSSVRTFLDEEK
SSDDKKLEEQQAMTEQLAKEKGISTFIEVLTAFNTNGLIGYRNSESVKSKGVPVPTRDIISNEIDVLLQTQKQFYQEILSDEY
CDRIVSAILFENEKIVPEAGCCPYFPDEKKLPRCHFLNEERRLWEAINNARIKMPMQEGAAKRYQSASFSDEQRHILFHIARS
GTDITPKLVQKEFPALKTSIIVLQGKEKAIQKIAGFRFRRLEEKSFWKRLSEEQKDDFFSAWTNTPDDKRLSKYLMKHLLLTE
NEVVDALKTVSLIGDYGPIGKTATQLLMKHLEDGLTYTEALERGMETGEFQELSVWEQQSLLPYYGQILTGSTQALMGKYWHS
AFKEKRDSEGFFKPNTNSDEEKYGRIANPVVHQTLNELRKLMNELITILGAKPQEITVELARELKVGAEKREDIIKQQTKQEK
EAVLAYSKYCEPNNLDKRYIERFRLLEDQAFVCPYCLEHISVADIAAGRADVDHIFPRDDTADNSYGNKVVAHRQCNDIKGKR
TPYAAFSNTSAWGPIMHYLDETPGMWRKRRKFETNEEEYAKYLQSKGFVSRFESDNSYIAKAAKEYLRCLFNPNNVTAVGSLK
GMETSILRKAWNLQGIDDLLGSRHWSKDADTSPTMRKNRDDNRHHGLDAIVALYCSRSLVQMINTMSEQGKRAVEIEAMIPIP
GYASEPNLSFEAQRELFRKKILEFMDLHAFVSMKTDNDANGALLKDTVYSILGADTQGEDLVFVVKKKIKDIGVKIGDYEEVA
SAIRGRITDKQPKWYPMEMKDKIEQLQSKNEAALQKYKESLVQAAAVLEESNRKLIESGKKPIQLSEKTISKKALELVGGYYY

-continued

LISNNKRTKTFVVKEPSNEVKGFAFDTGSNLCLDFYHDAQGKLCGEIIRKIQAMNPSYKPAYMKQGYSLYVRLYQGDVCELRA

SDLTEAESNLAKTTHVRLPNAKPGRTFVIIITFTEMGSGYQIYFSNLAKSKKGQDTSFTLTTIKNYDVRKVQLSSAGLVRYVS

PLLVDKIEKDEVALCGE

SEQ ID NO: 73

MNQKFILGLDIGITSVGYGLIDYETKNIIDAGVRLFPEANVENNEGRRSKRGSRRLKRRRIHRLERVKKLLEDYNLLDQSQIP

QSTNPYAIRVKGLSEALSKDELVIALLHIAKRRGIHKIDVIDSNDDVGNELSTKEQLNKNSKLLKDKFVCQIQLERMNEGQVR

GEKNRFKTADIIKEIIQLLNVQKNFHQLDENFINKYIELVEMRREYFEGPGKGSPYGWEGDPKAWYETLMGHCTYFPDELRSV

KYAYSADLFNALNDLNNLVIQRDGLSKLEYHEKYHIIENVFKQKKKPTLKQIANEINVNPEDIKGYRITKSGKPQFTEFKLYH

DLKSVLFDQSILENEDVLDQIAEILTIYQDKDSIKSKLTELDILLNEEDKENIAQLTGYTGTHRLSLKCIRLVLEEQWYSSRN

QMEIFTHLNIKPKKINLTAANKIPKAMIDEFILSPVVKRTFGQAINLINKIIEKYGVPEDIIIELARENNSKDKQKFINEMQK

KNENTRKRINEIIGKYGNQNAKRLVEKIRLHDEQEGKCLYSLESIPLEDLLNNPNHYEVDHIIPRSVSFDNSYHNKVLVKQSE

NSKKSNLTPYQYFNSGKSKLSYNQFKQHILNLSKSQDRISKKKKEYLLEERDINKFEVQKEFINRNLVDTRYATRELTNYLKA

YFSANNMNVKVKTINGSFTDYLRKVWKFKKERNHGYKHHAEDALIIANADFLFKENKKLKAVNSVLEKPEIESKQLDIQVDSE

DNYSEMFIIPKQVQDIKDFRNFKYSHRVDKKPNRQLINDTLYSTRKKDNSTYIVQTIKDIYAKDNTTLKKQFDKSPEKFLMYQ

HDPRTFEKLEVIMKQYANEKNPLAKYHEETGEYLTKYSKKNNGPIVKSLKYIGNKLGSHLDVTHQFKSSTKKLVKLSIKPYRF

DVYLTDKGYKFITISYLDVLKKDNYYYIPEQKYDKLKLGKAIDKNAKFIASFYKNDLIKLDGEIYKIIGVNSDTRNMIELDLP

DIRYKEYCELNNIKGEPRIKKTIGKKVNSIEKLTTDVLGNVFTNTQYTKPQLLFKRGN

SEQ ID NO: 74

MIMKLEKWRLGLDLGTNSIGWSVFSLDKDNSVQDLIDMGVRIFSDGRDPKTKEPLAVARRTARSQRKLIYRRKLRRKQVFKFL

QEQGLFPKTKEECMTLKSLNPYELRIKALDEKLEPYELGRALFNLAVRRGFKSNRKDGSREEVSEKKSPDEIKTQADMQTHLE

KAIKENGCRTITEFLYKNQGENGGIRFAPGRMTYYPTRKMYEEEFNLIRSKQEKYYPQVDWDDIYKAIFYQRPLKPQQRGYCI

YENDKERTFKAMPCSQKLRILQDIGNLAYYEGGSKKRVELNDNQDKVLYELLNSKDKVTFDQMRKALCLADSNSFNLEENRDF

LIGNPTAVKMRSKNRFGKLWDEIPLEEQDLIIETIITADEDDAVYEVIKKYDLTQEQRDFIVKNTILQSGTSMLCKEVSEKLV

KRLEEIADLKYHEAVESLGYKFADQTVEKYDLLPYYGKVLPGSTMEIDLSAFETNPEKHYGKISNPTVHVALNQTRVVVNALI

KEYGKPSQIAIELSRDLKNNVEKKAEIARKQNQRAKENIAINDTISALYHTAFPGKSFYPNRNDRMKYRLWSELGLGNKCIYC

GKGISGAELFTKEIEIEHILPFSRTLLDAESNLTVAHSSCNAFKAERSPFEAFGTNPSGYSWQEIIQRANQLKNTSKKNKFSP

NAMDSFEKDSSFIARQLSDNQYIAKAALRYLKCLVENPSDVWTTNGSMTKLLRDKWEMDSILCRKFTEKEVALLGLKPEQIGN

YKKNRFDHRHHAIDAVVIGLTDRSMVQKLATKNSHKGNRIEIPEFPILRSDLIEKVKNIVVSFKPDHGAEGKLSKETLLGKIK

LHGKETFVCRENIVSLSEKNLDDIVDEIKSKVKDYVAKHKGQKIEAVLSDFSKENGIKKVRCVNRVQTPIEITSGKISRYLSP

EDYFAAVIWEIPGEKKTFKAQYIRRNEVEKNSKGLNVVKPAVLENGKPHPAAKQVCLLHKDDYLEFSDKGKMYFCRIAGYAAT

NNKLDIRPVYAVSYCADWINSTNETMLTGYWKPTPTQNWVSVNVLFDKQKARLVTVSPIGRVFRK

SEQ ID NO: 75

MSSKAIDSLEQLDLFKPQEYTLGLDLGIKSIGWAILSGERIANAGVYLFETAEELNSTGNKLISKAAERGRKRRIRRMLDRKA

RRGRHIRYLLEREGLPTDELEEVVVHQSNRTLWDVRAEAVERKLTKQELAAVLFHLVRHRGYFPNTKKLPPDDESDSADEEQG

KINRATSRLREELKASDCKTIGQFLAQNRDRQRNREGDYSNLMARKLVFEEALQILAFQRKQGHELSKDFEKTYLDVLMGQRS

GRSPKLGNCSLIPSELRAPSSAPSTEWFKFLQNLGNLQISNAYREEWSIDAPRRAQIIDACSQRSTSSYWQIRRDFQIPDEYR

FNLVNYERRDPDVDLQEYLQQQERKTLANFRNWKQLEKIIGTGHPIQTLDEAARLITLIKDDEKLSDQLADLLPEASDKAITQ

LCELDFTTAAKISLEAMYRILPHMNQGMGFFDACQQESLPEIGVPPAGDRVPPFDEMYNPVVNRVLSQSRKLINAVIDEYGMP

AKIRVELARDLGKGRELRERIKLDQLDKSKQNDQRAEDFRAEFQQAPRGDQSLRYRLWKEQNCTCPYSGRMIPVNSVLSEDTQ

IDHILPISQSFDNSLSNKVLCFTEENAQKSNRTPFEYLDAADFQRLEAISGNWPEAKRNKLLHKSFGKVAEEWKSRALNDTRY

LTSALADHLRHHLPDSKIQTVNGRITGYLRKQWGLEKDRDKHTHHAVDAIVVACTTPAIVQQVTLYHQDIRRYKKLGEKRPTP

WPETFRQDVLDVEEEIFITRQPKKVSGGIQTKDTLRKHRSKPDRQRVALTKVKLADLERLVEKDASNRNLYEHLKQCLEESGD

-continued

QPTKAFKAPFYMPSGPEAKQRPILSKVTLLREKPEPPKQLTELSGGRRYDSMAQGRLDIYRYKPGGKRKDEYRVVLQRMIDLM

RGEENVHVFQKGVPYDQGPEIEQNYTFLFSLYFDDLVEFQRSADSEVIRGYYRTFNIANGQLKISTYLEGRQDFDFFGANRLA

HFAKVQVNLLGKVIK

SEQ ID NO: 76

MRSLRYRLALDLGSTSLGWALFRLDACNRPTAVIKAGVRIFSDGRNPKDGSSLAVTRRAARAMRRRDRLLKRKTRMQAKLVE

HGFFPADAGKRKALEQLNPYALRAKGLQEALLPGEFARALFHINQRRGFKSNRKTDKKDNDSGVLKKAIGQLRQQMAEQGSRT

VGEYLWTRLQQGQGVRARYREKPYTTEEGKKRIDKSYDLYIDRAMIEQEFDALWAAQAAFNPTLFHEAARADLKDTLLHQRPL

RPVKPGRCTLLPEEERAPLALPSTQRFRIHQEVNHLRLLDENLREVALTLAQRDAVVTALETKAKLSFEQIRKLLKLSGSVQF

NLEDAKRTELKGNATSAALARKELFGAAWSGFDEALQDEIVWQLVTEEGEGALIAWLQTHTGVDEARAQAIVDVSLPEGYGNL

SRKALARIVPALRAAVITYDKAVQAAGFDHHSQLGFEYDASEVEDLVHPETGEIRSVFKQLPYYGKALQRHVAFGSGKPEDPD

EKRYGKIANPTVHIGLNQVRMVVNALIRRYGRPTEVVIELARDLKQSREQKVEAQRRQADNQRRNARIRRSIAEVLGIGEERV

RGSDIQKWICWEELSFDAADRRCPYSGVQISAAMLLSDEVEVEHILPFSKTLDDSLNNRTVAMRQANRIKRNRTPWDARAEFE

AQGWSYEDILQRAERMPLRKRYRFAPDGYERWLGDDKDFLARALNDTRYLSRVAAEYLRLVCPGTRVIPGQLTALLRGKFGLN

DVLGLDGEKNRNDHRHHAVDACVIGVTDQGLMQRFATASAQARGDGLTRLVDGMPMPWPTYRDHVERAVRHIWVSHRPDHGFE

GAMMEETSYGIRKDGSIKQRRKADGSAGREISNLIRIHEATQPLRHGVSADGQPLAYKGYVGGSNYCIEITVNDKGKWEGEVI

STFRAYGVVRAGGMGRLRNPHEGQNGRKLIMRLVIGDSVRLEVDGAERTMRIVKISGSNGQIFMAPIHEANVDARNTDKQDAF

TYTSKYAGSLQKAKTRRVTISPIGEVRDPGFKG

SEQ ID NO: 77

MARPAFRAPRREHVNGWTPDPHRISKPFFILVSWHLLSRVVIDSSSGCFPGTSRDHTDKFAEWECAVQPYRLSFDLGTNSIGW

GLLNLDRQGKPREIRALGSRIFSDGRDPQDKASLAVARRLARQMRRRDRYLTRRTRLMGALVRFGLMPADPAARKRLEVAVD

PYLARERATRERLEPFEIGRALFHLNQRRGYKPVRTATKPDEEAGKVKEAVERLEAAIAAAGAPTLGAWFAWRKTRGETLRAR

LAGKGKEAAYPFYPARRMLEAEFDTLWAEQARHHPDLLTAEAREILRHRIFHQRPLKPPPVGRCTLYPDDGRAPRALPSAQRL

RLFQELASLRVIHLDLSERPLTPAERDRIVAFVQGRPPKAGRKPGKVQKSVPFEKLRGLLELPPGTGFSLESDKRPELLGDET

GARIAPAFGPGWTALPLEEQDALVELLLTEAEPERAIAALTARWALDEATAAKLAGATLPDFHGRYGRRAVAELLPVLERETR

GDPDGRVRPIRLDEAVKLLRGGKDHSDFSREGALLDALPYYGAVLERHVAFGTGNPADPEEKRVGRVANPTVHIALNQLRHLV

NAILARHGRPEEIVIELARDLKRSAEDRRREDKRQADNQKRNEERKRLILSLGERPTPRNLLKLRLWEEQGPVENRRCPYSGE

TISMRMLLSEQVDIDHILPFSVSLDDSAANKVVCLREANRIKRNRSPWEAFGHDSERWAGILARAEALPKNKRWRFAPDALEK

LEGEGGLRARHLNDTRHLSRLAVEYLRCVCPKVRVSPGRLTALLRRRWGIDAILAEADGPPPEVPAETLDPSPAEKNRADHRH

HALDAVVIGCIDRSMVQRVQLAAASAEREAAAREDNIRRVLEGFKEEPWDGFRAELERRARTIVVSHRPEHGIGGALHKETAY

GPVDPPEEGFNLVVRKPIDGLSKDEINSVRDPRLRRALIDRLAIRRRDANDPATALAKAAEDLAAQPASRGIRRVRVLKKESN

PIRVEHGGNPSGPRSGGPFHKLLLAGEVHHVDVALRADGRRWVGHWVTLFEAHGGRGADGAAAPPRLGDGERFLMRLHKGDCL

KLEHKGRVRVMQVVKLEPSSNSVVVVEPHQVKTDRSKHVKISCDQLRARGARRVTVDPLGRVRVHAPGARVGIGGDAGRTAME

PAEDIS

SEQ ID NO: 78

MKRTSLRAYRLGVDLGANSLGWFVVWLDDHGQPEGLGPGGVRIFPDGRNPQSKQSNAAGRRLARSARRRRDRYLQRRGKLMGL

LVKHGLMPADEPARKRLECLDPYGLRAKALDEVLPLHHVGRALFHLNQRRGLFANRAIEQGDKDASAIKAAAGRLQTSMQACG

ARTLGEFLNRRHQLRATVRARSPVGGDVQARYEFYPTRAMVDAEFEAIWAAQAPHHPTMTAEAHDTIREAIFSQRAMKRPSIG

KCSLDPATSQDDVDGFRCAWSHPLAQRFRIWQDVRNLAVVETGPTSSRLGKEDQDKVARALLQTDQLSFDEIRGLLGLPSDAR

FNLESDRRDHLKGDATGAILSARRHFGPAWHDRSLDRQIDIVALLESALDEAAIIASLGTTHSLDEAAAQRALSALLPDGYCR

LGLRAIKRVLPLMEAGRTYAEAASAAGYDHALLPGGKLSPTGYLPYYGQWLQNDVVGSDDERDTNERRWGRLPNPTVHIGIGQ

LRRVVNELIRWHGPPAEITVELTRDLKLSPRRLAELEREQAENQRKNDKRTSLLRKLGLPASTHNLLKLRLWDEQGDVASECP

YTGEAIGLERLVSDDVDIDHLIPFSISWDDSAANKVVCMRYANREKGNRTPFEAFGHRQGRPYDWADIAERAARLPRGKRWRF

GPGARAQFEELGDFQARLLNETSWLARVAKQYLAAVTHPHRIHVLPGRLTALLRATWELNDLLPGSDDRAAKSRKDHRHHAID

ALVAALTDQALLRRMANAHDDTRRKIEVLLPWPTFRIDLETRLKAMLVSHKPDHGLQARLHEDTAYGTVEHPETEDGANLVYR

KTFVDISEKEIDRIRDRRLRDLVRAHVAGERQQGKTLKAAVLSFAQRRDIAGHPNGIRHVRLTKSIKPDYLVPIRDKAGRIYK

SYNAGENAFVDILQAESGRWIARATTVFQANQANESHDAPAAQPIMRVFKGDMLRIDHAGAEKFVKIVRLSPSNNLLYLVEHH

QAGVFQTRHDDPEDSFRWLFASFDKLREWNAELVRIDTLGQPWRRKRGLETGSEDATRIGWTRPKKWP

SEQ ID NO: 79

MERIFGFDIGTTSIGFSVIDYSSTQSAGNIQRLGVRIFPEARDPDGTPLNQQRRQKRMMRRQLRRRRIRRKALNETLHEAGFL

PAYGSADWPVVMADEPYELRRRGLEEGLSAYEFGRAIYHLAQHRHFKGRELEESDTPDPDVDDEKEAANERAATLKALKNEQT

TLGAWLARRPPSDRKRGIHAHRNVVAEEFERLWEVQSKFHPALKSEEMRARISDTIFAQRPVFWRKNTLGECRFMPGEPLCPK

GSWLSQQRRMLEKLNNLAIAGGNARPLDAEERDAILSKLQQQASMSWPGVRSALKALYKQRGEPGAEKSLKFNLELGGESKLL

GNALEAKLADMFGPDWPAHPRKQEIRHAVHERLWAADYGETPDKKRVIILSEKDRKAHREAAANSFVADFGITGEQAAQLQAL

KLPTGWEPYSIPALNLFLAELEKGERFGALVNGPDWEGWRRTNFPHRNQPTGEILDKLPSPASKEERERISQLRNPTVVRTQN

ELRKVVNNLIGLYGKPDRIRIEVGRDVGKSKEREEIQSGIRRNEKQRKKATEDLIKNGIANPSRDDVEKWILWKEGQERCPY

TGDQIGFNALFREGRYEVEHIWPRSRSFDNSPRNKTLCRKDVNIEKGNRMPFEAFGHDEDRWSAIQIRLQGMVSAKGGTGMSP

GKVKRFLAKTMPEDFAARQLNDTRYAAKQILAQLKRLWPDMGPEAPVKVEAVTGQVTAQLRKLWTLNNILADDGEKTRADHRH

HAIDALTVACTHPGMTNKLSRYWQLRDDPRAEKPALTPPWDTIRADAEKAVSEIVVSHRVRKKVSGPLHKETTYGDTGTDIKT

KSGTYRQFVTRKKIESLSKGELDEIRDPRIKEIVAAHVAGRGGDPKKAFPPYPCVSPGGPEIRKVRLTSKQQLNLMAQTGNGY

ADLGSNHHIAIYRLPDGKADFEIVSLFDASRRLAQRNPIVQRTRADGASFVMSLAAGEAIMIPEGSKKGIWIVQGVWASGQVV

LERDTDADHSTTTRPMPNPILKDDAKKVSIDPIGRVRPSND

SEQ ID NO: 80

MNKRILGLDTGTNSLGWAVVDWDEHAQSYELIKYGDVIFQEGVKIEKGIESSKAAERSGYKAIRKQYFRRRLRKIQVLKVLVK

YHLCPYLSDDDLRQWHLQKQYPKSDELMLWQRTSDEEGKNPYYDRHRCLHEKLDLTVEADRYTLGRALYHLTQRRGFLSNRLD

TSADNKEDGVVKSGISQLSTEMEEAGCEYLGDYFYKLYDAQGNKVRIRQRYTDRNKHYQHEFDAICEKQELSSELIEDLQRAI

FFQLPLKSQRHGVGRCTFERGKPRCADSHPDYEEFRMLCFVNNIQVKGPHDLELRPLTYEEREKIEPLFFRKSKPNFDFEDIA

KALAGKKNYAWIHDKEERAYKFNYRMTQGVPGCPTIAQLKSIFGDDWKTGIAETYTLIQKKNGSKSLQEMVDDVWNVLYSFSS

VEKLKEFAHHKLQLDEESAEKFAKIKLSHSFAALSLKAIRKFLPFLRKGMYYTHASFFANIPTIVGKEIWNKEQNRKYIMENV

GELVFNYQPKHREVQGTIEMLIKDFLANNFELPAGATDKLYHPSMIETYPNAQRNEFGILQLGSPRTNAIRNPMAMRSLHILR

RVVNQLLKESIIDENTEVHVEYARELNDANKRRAIADRQKEQDKQHKKYGDEIRKLYKEETGKDIEPTQTDVLKFQLWEEQNH

HCLYTGEQIGITDFIGSNPKFDIEHTIPQSVGGDSTQMNLTLCDNRFNREVKKAKLPTELANHEEILTRIEPWKNKYEQLVKE

RDKQRTFAGMDKAVKDIRIQKRHKLQMEIDYWRGKYERFTMTEVPEGFSRRQGTIGIGLISRYAGLYLKSLFHQADSRNKSNVY

VVKGVATAEFRKMWGLQSEYEKKCRDNHSHHCMDAITIACIGKREYDLMAEYYRMEETFKQGRGSKPKFSKPWATFTEDVLNI

YKNLLVVHDTPNNMPKHTKKYVQTSIGKVLAQGDTARGSLHLDTYYGAIERDGEIRYVVRRPLSSFTKPEELENIVDETVKRT

IKEAIADKNFKQAIAEPIYMNEEKGILIKKVRCFAKSVKQPINIRQHRDLSKKEYKQQYHVMNENNYLLAIYEGLVKNKVVRE

FEIVSYIEAAKYYKRSQDRNIFSSIVPTHSTKYGLPLKTKLLMGQLVLMFEENPDEIQVDNTKDLVKRLYKVVGIEKDGRIKF

KYHQEARKEGLPIFSTPYKNNDDYAPIFRQSINNINILVDGIDFTIDILGKVTLKE

SEQ ID NO: 81

MNYKMGLDIGIASVGWAVINLDLKRIEDLGVRIFDKAEHPQNGESLALPRRIARSARRRLRRRKHRLERIRRLLVSENVLTKE

EMNLLFKQKKQIDVWQLRVDALERKLNNDELARVLLHLAKRRGFKSNRKSERNSKESSEFLKNIEENQSILAQYRSVGEMIVK

DSKFAYHKRNKLDSYSNMIARDDLEREIKLIFEKQREFNNPVCTERLEEKYLNIWSSQRPFASKEDIEKKVGFCTFEPKEKRA

PKATYTFQSFIVWEHINKLRLVSPDETRALTEIERNLLYKQAFSKNKMTYYDIRKLLNLSDDIHFKGLLYDPKSSLKQIENIR

FLELDSYHKIRKCIENVYGKDGIRMFNETDIDTFGYALTIFKDDEDIVAYLQNEYITKNGKRVSNLANKVYDKSLIDELLNLS

FSKFAHLSMKAIRNILPYMEQGEIYSKACELAGYNFTGPKKKEKALLLPVIPNIANPVVMRALTQSRKVVNAIIKKYGSPVSI

-continued

```
HIELARDLSHSFDERKKIQKDQTENRKKNETAIKQLIEYELTKNPTGLDIVKFKLWSEQQGRCMYSLKPIELERLLEPGYVEV

DHILPYSRSLDDSYANKVLVLTKENREKGNHTPVEYLGLGSERWKKFEKFVLANKQFSKKKKQNLLRLRYEETEEKEFKERNL

NDTRYISKFFANFIKEHLKFADGDGGQKVYTINGKITAHLRSRWDFNKNREESDLHHAVDAVIVACATQGMIKKITEFYKARE

QNKESAKKKEPIFPQPWPHFADELKARLSKFPQESIEAFALGNYDRKKLESLRPVFVSRMPKRSVTGAAHQETLRRCVGIDEQ

SGKIQTAVKTKLSDIKLDKDGHFPMYQKESDPRTYEAIRQRLLEHNNDPKKAFQEPLYKPKKNGEPGPVIRTVKIIDTKNKVV

HLDGSKTVAYNSNIVRTDVFEKDGKYYCVPVYTMDIMKGTLPNKAIEANKPYSEWKEMTEEYTFQFSLFPNDLVRIVLPREKT

IKTSTNEEIIIKDIFAYYKTIDSATGGLELISHDRNFSLRGVGSKTLKRFEKYQVDVLGNIHKVKGEKRVGLAAPTNQKKGKT

VDSLQSVSD
```

SEQ ID NO: 82
```
MRRLGLDLGTNSIGWCLLDLGDDGEPVSIFRTGARIFSDGRDPKSLGSLKATRREARLTRRRRDRFIQRQKNLINALVKYGLM

PADEIQRQALAYKDPYPIRKKALDEAIDPYEMGRAIFHINQRRGFKSNRKSADNEAGVVKQSIADLEMKLGEAGARTIGEFLA

DRQATNDTVRARRLSGTNALYEFYPDRYMLEQEFDTLWAKQAAFNPSLYIEAARERLKEIVFFQRKLKPQEVGRCIFLSDEDR

ISKALPSFQRFRIYQELSNLAWIDHDGVAHRITASLALRDHLFDELEHKKKLTFKAMRAILRKQGVVDYPVGFNLESDNRDHL

IGNLTSCIMRDAKKMIGSAWDRLDEEEQDSFILMLQDDQKGDDEVRSILTQQYGLSDDVAEDCLDVRLPDGHGSLSKKAIDRI

LPVLRDQGLIYYDAVKEAGLGEANLYDPYAALSDKLDYYGKALAGHVMGASGKFEDSDEKRYGTISNPTVHIALNQVRAVVNE

LIRLHGKPDEVVIEIGRDLPMGADGKRELERFQKEGRAKNERARDELKKLGHIDSRESRQKFQLWEQLAKEPVDRCCPFTGKM

MSISDLFSDKVEIEHLLPFSLTLDDSMANKTVCFRQANRDKGNRAPFDAFGNSPAGYDWQEILGRSQNLPYAKRWRFLPDAMK

RFEADGGFLERQLNDTRYISRYTTEYISTIIPKNKIWVVTGRLTSLLRGFWGLNSILRGHNTDDGTPAKKSRDDHRHHAIDAI

VVGMTSRGLLQKVSKAARRSEDLDLTRLFEGRIDPWDGFRDEVKKHIDAIIVSHRPRKKSQGALHNDTAYGIVEHAENGASTV

VHRVPITSLGKQSDIEKVRDPLIKSALLNETAGLSGKSFENAVQKWCADNSIKSLRIVETVSIIPITDKEGVAYKGYKGDGNA

YMDIYQDPTSSKWKGEIVSRFDANQKGFIPSWQSQFPTARLIMRLRINDLLKLQDGEIEEIYRVQRLSGSKILMAPHTEANVD

ARDRDKNDTFKLTSKSPGKLQSASARKVHISPTGLIREG
```

SEQ ID NO: 83
```
MKNILGLDLGLSSIGWSVIRENSEEQELVAMGSRVVSLTAAELSSFTQGNGVSINSQRTQKRTQRKGYDRYQLRRTLLRNKLD

TLGMLPDDSLSYLPKLQLWGLRAKAVTQRIELNELGRVLLHLNQKRGYKSIKSDFSGDKKITDYVKTVKTRYDELKEMRLTIG

ELFFRRLTENAFFRCKEQVYPRQAYVEEFDCIMNCQRKFYPDILTDETIRCIRDEIIYYQRPLKSCKYLVSRCEFEKRFYLNA

AGKKTEAGPKVSPRTSPLFQVCRLWESINNIVVKDRRNEIVFISAEQRAALFDFLNTHEKLKGSDLLKLLGLSKTYGYRLGEQ

FKTGIQGNKTRVEIERALGNYPDKKRLLQFNLQEESSSMVNTETGEIIPMISLSFEQEPLYRLWHVLYSIDDREQLQSVLRQK

FGIDDDEVLERLSAIDLVKAGFGNKSSKAIRRILPFLQLGMNYAEACEAAGYNHSNNYTKAENEARALLDRLPAIKKNELRQP

VVEKILNQMVNVVNALMEKYGRFDEIRVELARELKQSKEERSNTYKSINKNQRENEQIAKRIVEYGVPTRSRIQKYKMWEESK

HCCIYCGQPVDVGDFLRGFDVEVEHIIPKSLYFDDSFANKVCSCRSCNKEKNNRTAYDYMKSKGEKALSDYVERVNTMYTNNQ

ISKTKWQNLLTPVDKISIDFIDRQLRESQYIARKAKEILTSICYNVTATSGSVTSFLRHVWGWDTVLHDLNFDRYKKVGLTEV

IEVNHRGSVIRREQIKDWSKRFDHRHHAIDALTIACTKQAYIQRLNNLRAEEGPDFNKMSLERYIQSQPHFSVAQVREAVDRI

LVSFRAGKRAVTPGKRYIRKNRKRISVQSVLIPRGALSEESVYGVIHVWEKDEQGHVIQKQRAVMKYPITSINREMLDKEKVV

DKRIHRILSGRLAQYNDNPKEAFAKPVYIDKECRIPIRTVRCFAKPAINTLVPLKKDDKGNPVAWVNPGNNHHVAIYRDEDGK

YKERTVTFWEAVDRCRVGIPAIVTQPDTIWDNILQRNDISENVLESLPDVKWQFVLSLQQNEMFILGMNEEDYRYAMDQQDYA

LLNKYLYRVQKLSKSDYSFRYHTETSVEDKYDGKPNLKLSMQMGKLKRVSIKSLLGLNPHKVHISVLGEIKEIS
```

SEQ ID NO: 84
```
MAEKQHRWGLDIGTNSIGWAVIALIEGRPAGLVATGSRIFSDGRNPKDGSSLAVERRGPRQMRRRRDRYLRRRDRFMQALINV

GLMPGDAAARKALVTENPYVLRQRGLDQALTLPEFGRALFHLNQRRGFQSNRKTDRATAKESGKVKNAIAAFRAGMGNARTVG

EALARRLEDGRPVRARMVGQGKDEHYELYIAREWIAQEFDALWASQQRFHAEVLADAARDRLRAILLFQRKLLPVPVGKCFLE

PNQPRVAAALPSAQRFRLMQELNHLRVMTLADKRERPLSFQERNDLLAQLVARPKCGFDMLRKIVFGANKEAYRFTIESERRK
```

-continued

ELKGCDTAAKLAKVNALGTRWQALSLDEQDRLVCLLLDGENDAVLADALREHYGLTDAQIDTLLGLSFEDGHMRLGRSALLRV

LDALESGRDEQGLPLSYDKAVVAAGYPAHTADLENGERDALPYYGELLWRYTQDAPTAKNDAERKFGKIANPTVHIGLNQLRK

LVNALIQRYGKPAQIVVELARNLKAGLEEKERIKKQQTANLERNERIRQKLQDAGVPDNRENRLRMRLFEELGQGNGLGTPCI

YSGRQISLQRLFSNDVQVDHILPFSKTLDDSFANKVLAQHDANRYKGNRGPFEAFGANRDGYAWDDIRARAAVLPRNKRNRFA

ETAMQDWLHNETDFLARQLTDTAYLSRVARQYLTAICSKDDVYVSPGRLTAMLRAKWGLNRVLDGVMEEQGRPAVKNRDDHRH

HAIDAVVIGATDRAMLQQVATLAARAREQDAERLIGDMPTPWPNFLEDVRAAVARCVVSHKPDHGPEGGLHNDTAYGIVAGPF

EDGRYRVRHRVSLFDLKPGDLSNVRCDAPLQAELEPIFEQDDARAREVALTALAERYRQRKVWLEELMSVLPIRPRGEDGKTL

PDSAPYKAYKGDSNYCYELFINERGRWDGELISTFRANQAAYRRFRNDPARFRRYTAGGRPLLMRLCINDYIAVGTAAERTIF

RVVKMSENKITLAEHFEGGTLKQRDADKDDPFKYLTKSPGALRDLGARRIFVDLIGRVLDPGIKGD

SEQ ID NO: 86

MIERILGVDLGISSLGWAIVEYDKDDEAANRIIDCGVRLFTAAETPKKKESPNKARREARGIRRVLNRRRVRMNMIKKLFLRA

GLIQDVDLDGEGGMFYSKANRADVWELRHDGLYRLLKGDELARVLIHIAKHRGYKFIGDDEADEESGKVKKAGVVLRQNFEAA

GCRTVGEWLWRERGANGKKRNKHGDYEISIHRDLLVEEVEAIFVAQQEMRSTIATDALKAAYREIAFFVRPMQRIEKMVGHCT

YFPEERRAPKSAPTAEKFIAISKFFSTVIIDNEGWEQKIIERKTLEELLDFAVSREKVEFRHLRKFLDLSDNEIFKGLHYKGK

PKTAKKREATLFDPNEPTELEFDKVEAEKKAWISLRGAAKLREALGNEFYGRFVALGKHADEATKILTYYKDEGQKRRELTKL

PLEAEMVERLVKIGFSDFLKLSLKAIRDILFAMESGARYDEAVLMLGVPHKEKSAILPPLNKTDIDILNPTVIRAFAQFRKVA

NALVRKYGAFDRVHFELAREINTKGEIEDIKESQRKNEKERKEAADWIAETSFQVPLTRKNILKKRLYIQQDGRCAYTGDVIE

LERLFDEGYCEIDHILPRSRSADDSFANKVLCLARANQQKTDRTPYEWFGHDAARWNAFETRTSAPSNRVRTGKGKIDRLLKK

NFDENSEMAFKDRNLNDTRYMARAIKTYCEQYWVFKNSHTKAPVQVRSGKLTSVLRYQWGLESKDRESHTHHAVDAIIIAFST

QGMVQKLSEYYRFKETHREKERPKLAVPLANFRDAVEEATRIENTETVKEGVEVKRLLISRPPRARVTGQAHEQTAKPYPRIK

QVKNKKWRLAPIDEEKFESFKADRVASANQKNFYETSTIPRVDVYHKKGKFHLVPIYLHEMVLNELPNLSLGTNPEAMDENF

FKFSIFKDDLISIQTQGTPKKPAKIIMGYFKNMHGANMVLSSINNSPCEGFTCTPVSMDKKHKDKCKLCPEENRIAGRCLQGF

LDYWSQEGLRPPRKEFECDQGVKFALDVKKYQIDPLGYYYEVKQEKRLGTIPQMRSAKKLVKK

SEQ ID NO: 87
MNNSIKSKPEVTIGLDLGVGSVGWAIVDNETNIIHHLGSRLFSQAKTAEDRRSFRGVRRLIRRRKYKLKRFVNLIWKYNSYFGFKNKEDILNNY

QEQQKLHNTVLNLKSEALNAKIDPKALSWILHDYLKNRGHFYEDNRDFNVYPTKELAKYFDKYGYYKGIIDSKEDNDNKLEEEELTKYKFSNKHW

LEEVKKVLSNQTGLPEKFKEEYESLFSYVRNYSEGPGSINSVSPYGIYHLDEKEGKVVQKYNNIWDKTIGKCNIFPDEYRAPKNSPIAMIFNEI

NELSTIRSYSIYLTGWFINQEFKKAYLNKLLDLLIKTNGEKPIDARQFKKLREETIAESIGKETLKDVENEEKLEKEDHKWKLKGLKLNTNGKI

QYNDLSSLAKFVHKLKQHLKLDFLLEDQYATLDKINFLQSLFVYLGKHLRYSNRVDSANLKEFSDSNKLFERILQKQKDGLFKLFEQTDKDDEK

ILAQTHSLSTKAMLLAITRMTNLDNDEDNQKNNDKGWNFEAIKNFDQKFIDITKKNNNLSLKQNKRYLDDRFINDAILSPGVKRILREATKVFN

AILKQFSEEYDVTKVVIELARELSEEKELENTKNYKKLIKKNGDKISEGLKALGISEDEIKDILKSPTKSYKFLLWLQQDHIDPYSLKEIAFDD

IFTKTEKFEIDHIIPYSISFDDSSSNKLLVLAESNQAKSNQTPYEFISSGNAGIKWEDYEAYCRKFKDGDSSLLDSTQRSKKFAKMMKTDTSSK

YDIGFLARNLNDTRYATIVFRDALEDYANNHLVEDKPMFKVVCINGSVTSFLRKNFDDSSYAKKDRDKNIHHAVDASIISIFSNETKTLFNQLT

QFADYKLFKNTDGSWKKIDPKTGVVTEVTDENWKQIRVRNQVSEIAKVIEKYIQDSNIERKARYSRKIENKTNISLFNDTVYSAKKVGYEDQIK

RKNLKTLDIHESAKENKNSKVKRQFVYRKLVNVSLLNNDKLADLFAEKEDILMYRANPWVINLAEQIFNEYTENKKIKSQNVFEKYMLDLTKEF

PEKFSEFLVKSMLRNKTAIIYDDKKNIVHRIKRLKMLSSELKENKLSNVIIRSKNQSGTKLSYQDTINSLALMIMRSIDPTAKKQYIRVPLNTL

NLHLGDHDFDLHNMDAYLKKPKFVKYLKANEIGDEYKPWRVLTSGTLLIHKKDKKLMYISSFQNLNDVIEIKNLIETEYKENDDSDSKKKKKAN

RFLMTLSTILNDYILLDAKDNFDILGLSKNRIDEILNSKLGLDKIVK

SEQ ID NO: 88
MGGSEVGTVPVTWRLGVDVGERSIGLAAVSYEEDKPKEILAAVSWIHDGGVGDERSGASRLALRGMARRARRLRRFRRARLRDLDMLLSELGWT

PLPDKNVSPVDAWLARKRLAEEYVVDETERRRLLGYAVSHMARHRGWRNPWTTIKDLKNLPQPSDSWERTRESLEARYSVSLEPGTVGQWAGYL

LQRAPGIRLNPTQQSAGRRAELSNATAFETRLRQEDVLWELRCIADVQGLPEDVVSNVIDAVFCQKRPSVPAERIGRDPLDPSQLRASRACLEF

-continued

QEYRIVAAVANLRIRDGSGSRPLSLEERNAVIEALLAQTERSLTWSDIALEILKLPNESDLTSVPEEDGPSSLAYSQFAPFDETSARIAEFIAK

NRRKIPTFAQWWQEQDRTSRSDLVAALADNSIAGEEEQELLVHLPDAELEALEGLALPSGRVAYSRLTLSGLTRVMRDDGVDVHNARKTCFGVD

DNWRPPLPALHEATGHPVVDRNLAILRKFLSSATMRWGPPQSIVVELARGASESRERQAEEEAARRAHRKANDRIRAELRASGLSDPSPADLVR

ARLLELYDCHCMYCGAPISWENSELDHIVPRTDGGSNRHENLAITCGACNKEKGRRPFASWAETSNRVQLRDVIDRVQKLKYSGNMYWTRDEFS

RYKKSVVARLKRRTSDPEVIQSIESTGYAAVALRDRLLSYGEKNGVAQVAVFRGGVTAEARRWLDISIERLFSRVAIFAQSTSTKRLDRRHHAV

DAVVLTTLTPGVAKTLADARSRRVSAEFWRRPSDVNRHSTEEPQSPAYRQWKESCSGLGDLLISTAARDSIAVAAPLRLRPTGALHEETLRAFS

EHTVGAAWKGAELRRIVEPEVYAAFLALTDPGGRFLKVSPSEDVLPADENRHIVLSDRVLGPRDRVKLFPDDRGSIRVRGGAAYIASFHHARVF

RWGSSHSPSFALLRVSLADLAVAGLLRDGVDVFTAELPPWTPAWRYASIALVKAVESGDAKQVGWLVPGDELDFGPEGVTTAAGDLSMFLKYFP

ERHWVVTGFEDDKRINLKPAFLSAEQAEVLRTERSDRPDTLTEAGEILAQFFPRCWRATVAKVLCHPGLTVIRRTALGQPRWRRGHLPYSWRPW

SADPWSGGTP

SEQ ID NO: 89
MHNKKNITIGFDLGIASIGWAIIDSTTSKILDWGTRTFEERKTANERRAFRSTRRNIRRKAYRNQRFINLILKYKDLFELKNISDIQRANKKDT

ENYEKIISFFTEIYKKCAAKHSNILEVKVKALDSKIEKLDLIWILHDYLENRGFFYDLEEENVADKYEGIEHPSILLYDFFKKNGFFKSNSSIP

KDLGGYSFSNLQWVNEIKKLFEVQEINPEFSEKFLNLFTSVRDYAKGPGSEHSASEYGIFQKDEKGKVFKKYDNIWDKTIGKCSFFVEENRSPV

NYPSYEIFNLLNQLINLSTDLKTTNKKIWQLSSNDRNELLDELLKVKEKAKIISISLKKNEIKKIILKDFGFEKSDIDDQDTIEGRKIIKEEPT

TKLEVTKHLLATIYSHSSDSNWININNILEFLPYLDAICIILDREKSRGQDEVLKKLTEKNIFEVLKIDREKQLDFVKSIFSNTKFNFKKIGNF

SLKAIREFLPKMFEQNKNSEYLKWKDEEIRRKWEEQKSKLGKTDKKTKYLNPRIFQDEIISPGTKNTFEQAVLVLNQIIKKYSKENIIDAIIIE

SPREKNDKKTIEEIKKRNKKGKGKTLEKLFQILNLENKGYKLSDLETKPAKLLDRLRFYHQQDGIDLYTLDKINIDQLINGSQKYEIEHIIPYS

MSYDNSQANKILTEKAENLKKGKLIASEYIKRNGDEFYNKYYEKAKELFINKYKKNKKLDSYVDLDEDSAKNRFRFLTLQDYDEFQVEFLARNL

NDTRYSTKLFYHALVEHFENNEFFTYIDENSSKHKVKISTIKGHVTKYFRAKPVQKNNGPNENLNNNKPEKIEKNRENNEHHAVDAAIVAIIGN

KNPQIANLLTLADNKTDKKFLLHDENYKENIETGELVKIPKFEVDKLAKVEDLKKIIQEKYEEAKKHTAIKFSRKTRTILNGGLSDETLYGFKY

DEKEDKYFKIIKKKLVTSKNEELKKYFENPFGKKADGKSEYTVLMAQSHLSEFNKLKEIFEKYNGFSNKTGNAFVEYMNDLALKEPTLKAEIES

AKSVEKLLYYNFKPSDQFTYHDNINNKSFKRFYKNIRIIEYKSIPIKFKILSKHDGGKSFKDTLFSLYSLVYKVYENGKESYKSIPVTSQMRNF

GIDEFDFLDENLYNKEKLDIYKSDFAKPIPVNCKPVFVLKKGSILKKKSLDIDDDFKETKETEEGNYYFISTISKRFNRDTAYGLKPLKLSVVKP

VAEPSTNPIFKEYIPIHLDELGNEYPVKIKEHTDDEKLMCTIK

SEQ ID NO: 200 DNA2 endonuclease (CCDS 44415.2)
MEQLNELELLMEKSFWEEAELPAELFQKKVVASFPRTVLSTGMDNRYLVLAVNTVQNKEGNCEKRLVITASQSLENKELCILRNDWCSVPVEPG DIIHLEGDCTSDTWIIDKDFGYLILYPDMLISGTSIASSIRCMRRAVLSETFRSSDPATRQMLIGTVLHEVFQKAINNSFAPEKLQELAFQTIQ EIRHLKEMYRLNLSQDEIKQEVEDYLPSFCKWAGDFMHKNTSTDFPQMQLSLPSDNSKDNSTCNIEVVKPMDIEESIWSPRFGLKGKIDVTVGV KIHRGYKTKYKIMPLELKTGKESNSIEHRSQVVLYTLLSQERRADPEAGLLLYLKTGQMYPVPANHLDKRELLKLRNQMAFSLFHRISKSATRQ KTQLASLPQIIEEEKTCKYCSQIGNCALYSRAVEQQMDCSSVPIVMLPKIEEETQHLKQTHLEYFSLWCLMLTLESQSKDNKKNHQNIWLMPAS EMEKSGSCIGNLIRMEHVKIVCDGQYLHNFQCKHGAIPVTNLMAGDRVIVSGEERSLFALSRGYVKEINMTTVTCLLDRNLSVLPESTLFRLDQ EEKNCDIDTPLGNLSKLMENTFVSKKLRDLIIDFREPQFISYLSSVLPHDAKDTVACILKGLNKPQRQAMKKVLLSKDYTLIVGMPGTGKTTTI CTLVRILYACGFSVLLTSYTHSAVDNILLKLAKFKIGFLRLGQIQKVHPAIQQFTEQEICRSKSIKSLALLEELYNSQLIVATTCMGINHPIFS RKIFDFCIVDEASQISQPICLGPLFFSRRFVLVGDHQQLPPLVLNREARALGMSESLFKRLEQNKSAVVQLTVQYRMNSKIMSLSNKLIYEGKL ECGSDKVANAVINLRHFKDVKLELEFYADYSDNPWLMGVFEPNNPVCFLNTDKVPAPEQVEKGGVSNVTEAKLIVFLTSIFVKAGCSPSDIGII APYRQQLKIINDLLARSIGMVEVNTVDKYQGRDKSIVLVSFVRSNKDGTVGELLKDWRRLNVAITRAKHKLILLGCVPSLNCYPPLEKLLNHLN

SEKLIIDLPSREHESLCHILGDFQRE

-continued

Ezh2
>sp|Q15910|EZH2_HUMAN Histone-lysine N-methyltransferase EZH2 OS = *Homo sapiens*
GN = EZH2 PE = 1 SV = 2
MGQTGKKSEKGPVCWRKRVKSEYMRLRQLKRFRRADEVKSMFSSNRQKILERTEILNQEWKQRRIQPVHILTSVSSLRGTRECSVTSDLDFPTQ VIPLKTLNAVASVPIMYSWSPLQQNFMVEDETVLHNIPYMGDEVLDQDGTFIEELIKNYDGKVHGDRECGFINDEIFVELVNALGQYNDDDDDD DGDDPEEREEKQKDLEDHRDDKESRPPRKFPSDKIFEAISSMFPDKGTAEELKEKYKELTEQQLPGALPPECTPNIDGPNAKSVQREQSLHSFH TLFCRRCFKYDCFLHPFHATPNTYKRKNTETALDNKPCGPQCYQHLEGAKEFAAALTAERIKTPPKRPGGRRRGRLPNNSSRPSTPTINVLESK DTDSDREAGTETGGENNDKEEEEKKDETSSSSEANSRCQTPIKMKPNIEPPENVEWSGAEASMFRVLIGTYYDNFCAIARLIGTKTCRQVYEFR VKESSIIAPAPAEDVDTPPRKKKRKHRLWAAHCRKIQLKKDGSSNHVYNYQPCDHPRQPCDSSCPCVIAQNFCEKFCQCSSECQNRFPGCRCKA QCNTKQCPCYLAVRECDPDLCLTCGAADHWDSKNVSCKNCSIQRGSKKHLLLAPSDVAGWGIFIKDPVQKNEFISEYCGEIISQDEADRRGKVY DKYMCSFLFNLNNDFVVDATRKGNKIRFANHSVNPNCYAKVMMVNGDHRIGIFAKRAIQTGEELFFDYRYSQADALKYVGIEREMEIP >sp|Q15910-2|EZH2_HUMAN Isoform 2 of Histone-lysine N-methyltransferase EZH2 OS = *Homo sapiens*
GN = EZH2
MGQTGKKSEKGPVCWRKRVKSEYMRLRQLKRFRRADEVKSMFSSNRQKILERTEILNQEWKQRRIQPVHILTSVSSLRGTRECSVTSDLDFPTQ VIPLKTLNAVASVPIMYSWSPLQQNFMVEDETVLHNIPYMGDEVLDQDGTFIEELIKNYDGKVHGDRECGFINDEIFVELVNALGQYNDDDDDD DGDDPEEREEKQKDLEDHRDDKESRPPRKFPSDKIFEAISSMFPDKGTAEELKEKYKELTEQQLPGALPPECTPNIDGPNAKSVQREQSLHSFH TLFCRRCFKYDCFLHRKCNYSFHATPNTYKRKNTETALDNKPCGPQCYQHLEGAKEFAAALTAERIKTPPKRPGGRRRGRLPNNSSRPSTPTIN VLESKDTDSDREAGTETGGENNDKEEEEKKDETSSSSEANSRCQTPIKMKPNIEPPENVEWSGAEASMFRVLIGTYYDNFCAIARLIGTKTCRQ VYEFRVKESSIIAPAPAEDVDTPPRKKKRKHRLWAAHCRKIQLKKDGSSNHVYNYQPCDHPRQPCDSSCPCVIAQNFCEKFCQCSSECQNRFPG CRCKAQCNTKQCPCYLAVRECDPDLCLTCGAADHWDSKNVSCKNCSIQRGSKKHLLLAPSDVAGWGIFIKDPVQKNEFISEYCGEIISQDEADR RGKVYDKYMCSFLFNLNNDFVVDATRKGNKIRFANHSVNPNCYAKVMMVNGDHRIGIFAKRAIQTGEELFFDYRYSQADALKYVGIEREMEIP >sp|Q15910-3|EZH2_HUMAN Isoform 3 of Histone-lysine N-methyltransferase EZH2
OS = *Homo sapiens* GN = EZH2
MGQTGKKSEKGPVCWRKRVKSEYMRLRQLKRFRRADEVKSMFSSNRQKILERTEILNQEWKQRRIQPVHILTSVSSLRGTREVEDETVLHNIPY MGDEVLDQDGTFIEELIKNYDGKVHGDRECGFINDEIFVELVNALGQYNDDDDDDGDDPEEREEKQKDLEDHRDDKESRPPRKFPSDKIFEAI SSMFPDKGTAEELKEKYKELTEQQLPGALPPECTPNIDGPNAKSVQREQSLHSFHTLFCRRCFKYDCFLHPFHATPNTYKRKNTETALDNKPCG PQCYQHLEGAKEFAAALTAERIKTPPKRPGGRRRGRLPNNSSRPSTPTINVLESKDTDSDREAGTETGGENNDKEEEEKKDETSSSSEANSRCQ TPIKMKPNIEPPENVEWSGAEASMFRVLIGTYYDNFCAIARLIGTKTCRQVYEFRVKESSIIAPAPAEDVDTPPRKKKRKHRLWAAHCRKIQLK KDGSSNHVYNYQPCDHPRQPCDSSCPCVIAQNFCEKFCQCSSECQNRFPGCRCKAQCNTKQCPCYLAVRECDPDLCLTCGAADHWDSKNVSCKN CSIQRGSKKHLLLAPSDVAGWGIFIKDPVQKNEFISEYCGEIISQDEADRRGKVYDKYMCSFLENLNNDFVVDATRKGNKIRFANHSVNPNCYA

KVMMVNGDHRIGIFAKRAIQTGEELFFDYRYSQADALKYVGIEREMEIP

HDAC1
>sp|Q13547|HDAC1_HUMAN Histone deacetylase 1 OS = *Homo sapiens*
GN = HDAC1 PE = 1 SV = 1
MAQTQGTRRKVCYYYDGDVGNYYYGQGHPMKPHRIRMTHNLLLNYGLYRKMEIYRPHKANAEEMTKYHSDDYIKFLRSIRPDNMSEYSKQMQRF NVGEDCPVFDGLFEFCQLSTGGSVASAVKLNKQQTDIAVNWAGGLHHAKKSEASGFCYVNDIVLAILELLKYHQRVLYIDIDIHHGDGVEEAFY TTDRVMTVSFHKYGEYFPGTGDLRDIGAGKGKYYAVNYPLRDGIDDESYEAIFKPVMSKVMEMFQPSAVVLQCGSDSLSGDRLGCFNLTIKGHA KCVEFVKSFNLPMLMLGGGGYTIRNVARCWTYETAVALDTEIPNELPYNDYFEYFGPDFKLHISPSNMTNQNTNEYLEKIKQRLFENLRMLPHA PGVQMQAIPEDAIPEESGDEDEDDPDKRISICSSDKRIACEEEFSDSEEEGEGGRKNSSNFKKAKRVKTEDEKEKDPEEKKEVTEEEKTKEEKP

EAKGVKEEVKLA

HDAC2
MAYSQGGGKKKVCYYYDGDIGNYYYGQGHPMKPHRIRMTHNLLLNYGLYRKMETYRPHKATAEEMTKYHSDEYIKFLRSIRPDNMSEYSKQMQR

FNVGEDCPVFDGLFEFCQLSTGGSVAGAVKLNRQQTDMAVNWAGGLHHAKKSEASGFCYVNDIVLAILELLKYHQRVLYIDIDIHHGDGVEEAF

YTTDRVMTVSFHKYGEYFPGTGDLRDIGAGKGKYYAVNFPMRDGIDDESYGQIFKPIISKVMEMYQPSAVVLQCGADSLSGDRLGCFNLTVKGH

-continued

```
AKCVEVVKTFNLPLLMLGGGGYTIRNVARCWTYETAVALDCEIPNELPYNDYFEYFGPDFKLHISPSNMTNQNTPEYMEKIKQRLFENLRMLPH

APGVQMQAIPEDAVHEDSGDEDGEDPDKRISIRASDKRIACDEEFSDSEDEGEGGRRNVADHKKGAKKARIEEDKKETEDKKTDVKEEDKSKDN

SGEKTDTKGTKSEQLSNP

KDM4A/JMJD2A
>sp|O75164|KDM4A_HUMAN Lysine-specific demethylase 4A OS = Homo sapiens
GN = KDM4A PE = 1 SV = 2
MASESETLNPSARIMTFYPTMEEFRNFSRYIAYIESQGAHRAGLAKVVPPKEWKPRASYDDIDDLVIPAPIQQLVTGQSGLFTQYNIQKKAMTV REFRKIANSDKYCTPRYSEFEELERKYWKNLTFNPPIYGADVNGTLYEKHVDEWNIGRLRTILDLVEKESGITIEGVNTPYLYFGMWKTSFAWH TEDMDLYSINYLHFGEPKSWYSVPPEHGKRLERLAKGFFPGSAQSCEAFLRHKMTLISPLMLKKYGIPFDKVTQEAGEFMITFPYGYHAGFNHG FNCAESTNFATRRWIEYGKQAVLCSCRKDMVKISMDVFVRKFQPERYKLWKAGKDNTVIDHTLPTPEAAEFLKESELPPRAGNEEECPEEDMEG VEDGEEGDLKTSLAKHRIGTKRHRVCLEIPQEVSQSELFPKEDLSSEQYEMTECPAALAPVRPTHSSVRQVEDGLTFPDYSDSTEVKFEELKNV KLEEEDEEEEQAAAALDLSVNPASVGGRLVFSGSKKKSSSSLGSGSSRDSISSDSETSEPLSCRAQGQTGVLTVHSYAKGDGRVTVGEPCTRKK GSAARSFSERELAEVADEYMFSLEENKKSKGRRQPLSKLPRHHPLVLQECVSDDETSEQLTPEEEAEETEAWAKPLSQLWQNRPPNFEAEKEFN ETMAQQAPHCAVCMIFQTYHQVEFGGFNQNCGNASDLAPQKQRTKPLIPEMCFTSTGCSTDINLSTPYLEEDGTSILVSCKKCSVRVHASCYGV PPAKASEDWMCSRCSANALEEDCCLCSLRGGALQRANDDRWVHVSCAVAILEARFVNIAERSPVDVSKIPLPRFKLKCIFCKKRRKRTAGCCVQ CSHGRCPTAFHVSCAQAAGVMMQPDDWPFVVFITCFRHKIPNLERAKGALQSITAGQKVISKHKNGRFYQCEVVRLTTETFYEVNFDDGSFSDN LYPEDIVSQDCLQFGPPAEGEVVQVRWTDGQVYGAKFVASHPIQMYQVEFEDGSQLVVKRDDVYTLDEELPKRVKSRLSVASDMRFNEIFTEKE

VKQEKKRQRVINSRYREDYIEPALYRAIME

>sp|O75164-2|KDM4A_HUMAN Isoform 2 of Lysine-specific demethylase 4A
OS = Homo sapiens GN = KDM4A
MFSLEENKKSKGRRQPLSKLPRHHPLVLQECVSDDETSEQLTPEEEAEETEAWAKPLSQLWQNRPPNFEAEKEFNETMAQQAPHCAVCMIFQTY HQVEFGGFNQNCGNASDLAPQKQRTKPLIPEMCFTSTGCSTDINLSTPYLEEDGTSILVSCKKCSVRVHASCYGVPPAKASEDWMCSRCSANAL EEDCCLCSLRGGALQRANDDRWVHVSCAVAILEARFVNIAERSPVDVSKIPLPRFKLKCIFCKKRRKRTAGCCVQCSHGRCPTAFHVSCAQAAG VMMQPDDWPFVVFITCFRHKIPNLERAKGALQSITAGQKVISKHKNGRFYQCEVVRLTTETFYEVNFDDGSFSDNLYPEDIVSQDCLQFGPPAE GEVVQVRWTDGQVYGAKFVASHPIQMYQVEFEDGSQLVVKRDDVYTLDEELPKRVKSRLSVASDMRFNEIFTEKEVKQEKKRQRVINSRYREDY

IEPALYRAIME
```

Unless otherwise defined, all technical and scientific terms used herein have the same meaning as commonly understood by one of ordinary skill in the art to which this invention belongs. Although methods and materials similar or equivalent to those described herein can be used in the practice or testing of the present invention, suitable methods and materials are described below. In addition, the materials, methods, and examples are illustrative only and not intended to be limiting.

Headings, including numeric and alphabetical headings and subheadings, are for organization and presentation and are not intended to be limiting.

Incorporation by Reference

All publications, patents, and patent applications mentioned herein are hereby incorporated by reference in their entirety as if each individual publication, patent, or patent application was specifically and individually indicated to be incorporated by reference. In case of conflict, the present application, including any definitions herein, will control.

Equivalents

Those skilled in the art will recognize, or be able to ascertain using no more than routine experimentation, many equivalents to the specific embodiments of the invention described herein. Such equivalents are intended to be encompassed by the following claims.

SEQUENCE LISTING (2288 sequences)

SEQ ID NO: 1 - RNA, 96 nt, Artificial Sequence
  Synthetic
  misc_feature (1)..(20): n is a, c, g, or u
nnnnnnnnnnnnnnnnnnnnguuuuagagcuagaaauagcaaguuaaaauaaggcuaguccguuaucaacuugaaaaaguggcaccgagucggugc

SEQ ID NO: 2 - RNA, 104 nt, Artificial Sequence
  Synthetic
  misc_feature (1)..(20): n is a, c, g, or u
nnnnnnnnnnnnnnnnnnnnguuuuagagcuaugcugaaaagcauagcaaguuaaaauaaggcuaguccguuaucaacuugaaaaaguggcaccgagucggugc

SEQ ID NO: 3 - RNA, 106 nt, Artificial Sequence
  Synthetic
  misc_feature (1)..(20): n is a, c, g, or u
nnnnnnnnnnnnnnnnnnnnguuuuagagcuaugcuggaaacagcauagcaaguuaaaauaaggcuaguccguuaucaacuugaaaaaguggcaccgagucggugc

SEQ ID NO: 4 - RNA, 116 nt, Artificial Sequence
  Synthetic
  misc_feature (1)..(20): n is a, c, g, or u
nnnnnnnnnnnnnnnnnnnnguuuuagagcuaugcuguuuuggaaacaaaacagcauagcaaguuaaaauaaggcuaguccguuaucaacuugaaaaaguggcaccgagucggugc

SEQ ID NO: 5 - RNA, 96 nt, Artificial Sequence
  Synthetic
  misc_feature (1)..(20): n is a, c, g, or u
nnnnnnnnnnnnnnnnnnnnguauuagagcuagaaauagcaaguuaauauaaggcuaguccguuaucaacuugaaaaaguggcaccgagucggugc

SEQ ID NO: 6 - protein, 1053 aa, Staphylococcus aureus
MKRNYILGLDIGITSVGYGIIDYETRDVIDAGVRLFKEANVENNEGRRSKRGARRLKRRRRHRIQRVKKLLFDYNLLTDHSELSGINPYEARVKGLSQKLSEEEFSAALLHLAKRRGVHNVNEVEEDTGNELSTKEQISRNSKALEEKYVAELQLERLKKDGEVRGSINRFKTSDYVKEAKQLLKVQKAYHQLDQSFIDTYIDLLETRRTYYEGPGEGSPFGWKDIKEWYEMLMGHCTYFPEELRSVKYAYNADLYNALNDLNNLVITRDENEKLEYYEKFQIIENVFKQKKKPTLKQIAKEILVNEEDIKGYRVTSTGKPEFTNLKVYHDIKDITARKEIIENAELLDQIAKILTIYQSSEDIQEELTNLNSELTQEEIEQISNLKGYTGTHNLSLKAINLILDELWHTNDNQIAIFNRLKLVPKKVDLSQQKEIPTTLVDDFILSPVVKRSFIQSIKVINAIIKKYGLPNDIIIELAREKNSKDAQKMINEMQKRNRQTNERIEEIIRTTGKENAKYLIEKIKLHDMQEGKCLYSLEAIPLEDLLNNPFNYEVDHIIPRSVSFDNSFNNKVLVKQEENSKKGNRTPFQYLSSSDSKISYETFKKHILNLAKGKGRISKTKKEYLLEERDINRFSVQKDFINRNLVDTRYATRGLMNLLRSYFRVNNLDVKVKSINGGFTSFLRRKWKFKKERNKGYKHHAEDALIIANADFIFKEWKKLDKAKKVMENQMFEEKQAESMPEIETEQEYKEIFITPHQIKHIKDFKDYKYSHRVDKKPNRELINDTLYSTRKDDKGNTLIVNNLNGLYDKDNDKLKKLINKSPEKLLMYHHDPQTYQKLKLIMEQYGDEKNPLYKYYEETGNYLTKYSKKDNGPVIKKIKYYGNKLNAHLDITDDYPNSRNKVVKLSLKPYRFDVYLDNGVYKFVTVKNLDVIKKENYYEVNSKCYEEAKKLKKISNQAEFIASFYNNDLIKINGELYRVIGVNNDLLNRIEVNMIDITYREYLENMNDKRPPRIIKTIASKTQSIKKYSTDILGNLYEVKSKKHPQIIKKG

SEQ ID NO: 7 - protein, 1368 aa, Streptococcus pyogenes [sequence omitted]

SEQ ID NO: 8 - protein, 984 aa, Campylobacter jejuni NCTC 11168
MARILAFDIGISSIGWAFSENDELKDCGVRIFTKVENPKTGESLALPRRLARSARKRLARRKARLNHLKHLIANEFKLNYEDYQSFDESLAKAYKGSLISPYELRFRALNELLSKQDFARVILHIAKRRGYDDIKNSDDKEKGAILKAIKQNEEKLANYQSVGEYLYKEYFQKFKENSKEFTNVRNKKESYERCIAQSFLKDELKLIFKKQREFGFSFSKKFEEEVLSVAFYKRALKDFSHLVGNCSFFTDEKRAPKNSPLAFMFVALTRIINLLNNLKNTEGILYTKDDLNALLNEVLKNGTLTYKQTKKLLGLSDDYEFKGEKGTYFIEFKKYKEFIKALGEHNLSQDDLNEIAKDITLIKDEIKLKKALAKYDLNQNQIDSLSKLEFKDHLNISFKALKLVTPLMLEGKKYDEACNELNLKVAINEDKKDFLPAFNETYYKDEVTNPVVLRAIKEYRKVLNALLKKYGKVHKINIELAREVGKNHSQRAKIEKEQNENYKAKKDAELECEKLGLKINSKNILKLRLFKEQKEFCAYSGEKIKISDLQDEKMLEIDHIYPYSRSFDDSYMNKVLVFTKQNQEKLNQTPFEAFGNDSAKWQKIEVLAKNLPTKKQKRILDKNYKDKEQKNFKDRNLNDTRYIARLVLNYTKDYLDFLPLSDDENTKLNDTQKGSKVHVEAKSGMLTSALRHTWGFSAKDRNNHLHHAIDAVIIAYANNSIVKAFSDFKKEQESNSAELYAKKISELDYKNKRKFFEPFSGFRQKVLDKIDEIFVSKPERKKPSGALHEETFRKEEEFYQSYGGKEGVLKALELGKIRKVNGKIVKNGDMFRVDIFKHKKTNKFYAVPIYTMDFALKVLPNKAVARSKKGEIKDWILMDENYEFCFSLYKDSLILIQTKDMQEPEFVYYNAFTSSTVSLIVSKHDNKFETLSKNQKILFKNANEKEVIAKSIGIQNLKVFEKYIVSALGEVTKAEFRQREDFKK

SEQ ID NO: 9 - protein, 1436 aa, Bacteroides fragilis NCTC 9343
MKRILGLDLGTNSIGWALVNEAENKDERSSIVKLGVRVNPLTVDELTNFEKGKSITTNADRTLKRGMRRNLQRYKLRRETLTEVLKEHKLITEDTILSENGNRTTFETYRLRAKAVTEEISLEEFARVLLMINKKRGYKSSRKAKGVEEGTLIDGMDIARELYNNNLTPGELCLQLLDAGKKFLPDFYRSDLQNELDRIWEKQKEYYPEILTDVLKEELRGKKRDAVWAICAKYFVWKENYTEWNKEKGKTEQQEREHKLEGIYSKRKRDEAKRENLQWRVNGLKEKLSLEQLVIVFQEMNTQINNSSGYLGAISDRSKELYFNKQTVGQYQMEMLDKNPNASLRNMVFYRQDYLDEFNMLWEKQAVYHKELTEELKKEIRDIIIFYQRRLKSQKGLIGFCEFESRQIEVDIDGKKKIKTVGNRVISRSSPLFQEFKIWQILNNIEVTVVGKKRKRRKLKENYSALFEELNDAEQLELNGSRRLCQEEKELLAQELFIRDKMTKSEVLKLLFDNPQELDLNFKTIDGNKTGYALFQAYSKMIEMSGHEPVDFKKPVEKVVEYIKAVFDLLNWNTDILGFNSNEELDNQPYYKLWHLLYSFEGDNTPTGNGRLIQKMTELYGFEKEYATILANVSFQDDYGSLSAKAIHKILPHLKEGNRYDVACVYAGYRHSESSLTREEIANKVLKDRLMLLPKNSLHNPVVEKILNQMVNVINVIIDIYGKPDEIRVELARELKKNAKEREELTKSIAQTTKAHEEYKTLLQTEFGLTNVSRTDILRYKLYKELESCGYKTLYSNTYISREKLFSKEFDIEHIIPQARLFDDSFSNKTLEARSVNIEKGNKTAYDFVKEKFGESGADNSLEHYLNNIEDLFKSGKISKTKYNKLKMAEQDIPDGFIERDLRNTQYIAKKALSMLNEISHRVVATSGSVTDKLREDWQLIDVMKELNWEKYKALGLVEYFEDRDGRQIGRIKDWTKRNDHRHHAMDALTVAFTKDVFIQYFNNKNASLDPNANEHAIKNKYFQNGRAIAPMPLREFRAEAKKHLENTLISIKAKNKVITGNINKTRKKGGVNKNMQQTPRGQLHLETIYGSGKQYLTKEEKVNASFDMRKIGTVSKSAYRDALLKRLYENDNDPKKAFAGKNSLDKQPIWLDKEQMRKVPEKVKIVTLEAIYTIRKEISPDLKVDKVIDVGVRKILIDRLNEYGNDAKKAFSNLDKNPIWLNKEKGISIKRVTISGISNAQSLHVKKDKDGKPILDENGRNIPVDFVNTGNNHHVAVYYRPVIDKRGQLVVDEAGNPKYELEEVVVSFFEAVTRANLGLPIIDKDYKTTEGWQFLFSMKQNEYFVFPNEKTGFNPKEIDLLDVENYGLISPNLFRVQKFSLKNYVFRHHLETTIKDTSSILRGITWIDFRSSKGLDTIVKVRVNHIGQIVSVGEY

SEQ ID NO: 10 - protein, 1420 aa, Bifidobacterium bifidum S17
MSRKNYVDDYAISLDIGNASVGWSAFTPNYRLVRAKGHELIGVRLFDPADTAESRRMARTTRRRYSRRRWRLRLLDALFDQALSEIDPSFLARRKYSWVHPDDENNADCWYGSVLFDSNEQDKRFYEKYPTIYHLRKALMEDDSQHDIREIYLAIHHMVKYRGNFLVEGTLESSNAFKEDELLKLLGRITRYEMSEGEQNSDIEQDDENKLVAPANGQLADALCATRGSRSMRVDNALEALSAVNDLSREQRAIVKAIFAGLEGNKLDLAKIFVSKEFSSENKKILGIYFNKSDYEEKCVQIVDSGLLDDEEREFLDRMQGQYNAIALKQLLGRSTSVSDSKCASYDAHRANWNLIKLQLRTKENEKDINENYGILVGWKIDSGQRKSVRGESAYENMRKKANVFFKKMIETSDLSETDKNRLIHDIEEDKLFPIQRDSDNGVIPHQLHQNELKQIIKKQGKYYPFLLDAFEKDGKQINKIEGLLTFRVPYFVGPLVVPEDLQKSDNSENHWMVRKKKGEITPWNFDEMVDKDASGRKFIERLVGTDSYLLGEPTLPKNSLLYQEYEVLNELNNVRLSVRTGNHWNDKRRMRLGREEKTLLCQRLFMKGQTVTKRTAENLLRKEYGRTYELSGLSDESKFTSSLSTYGKMCRIFGEKYVNEHRDLMEKIVELQTVFEDKETLLHQLRQLEGISEADCALLVNTHYTGWGRLSRKLLTTKAGECKISDDFAPRKHSIIEIMRAEDRNLMEIITDKQLGFSDWIEQENLGAENGSSLMEVVDDLRVSPKVKRGIIQSIRLIDDISKAVGKRPSRIFLELADDIQPSGRTISRKSRLQDLYRNANLGKEFKGIADELNACSDKDLQDDRLFLYYTQLGKDMYTGEELDLDRLSSAYDIDHIIPQAVTQNDSIDNRVLVARAENARKTDSFTYMPQIADRMRNFWQILLDNGLISRVKFERLTRQNEFSEREKERFVQRSLVETRQIMKNVATLMRQRYGNSAAVIGLNAELTKEMHRYLGFSHKNRDINDYHHAQDALCVGIAGQFAANRGFFADGEVSDGAQNSYNQYLRDYLRGYREKLSAEDRKQGRAFGFIVGSMRSQDEQKRVNPRTGEVVWSEEDKDYLRKVMNYRKMLVTQKVGDDFGALYDETRYAATDPKGIKGIPFDGAKQDTSLYGGFSSAKPAYAVLIESKGKTRLVNVTMQEYSLLGDRPSDDELRKVLAKKKSEYAKANILLRHVPKMQLIRYGGGLMVIKSAGELNNAQQLWLPYEEYCYFDDLSQGKGSLEKDDLKKLLDSILGSVQCLYPWHRFTEEELADLHVAFDKLPEDEKKNVITGIVSALHADAKTANLSIVGMTGSWRRMNNKSGYTFSDEDEFIFQSPSGLFEKRVTVGELKRKAKKEVNSKYRTNEKRLPTLSGASQP

SEQ ID NO: 11 - protein, 1397 aa, Veillonella atypica ACS134VCol7a
METQTSNQLITSHLKDYPKQDYFVGLDIGTNSVGWAVTNTSYELLKFHSHKMWGSRLFEEGESAVTRRGFRSMRRRLERRKLRLKLLEELFADAMAQVDSTFFIRLHESKYHYEDKTTGHSSKHILFIDEDYTDQDYFTEYPTIYHLRKDLMENGTDDIRKLFLAVHHILKYRGNFLYEGATFNSNAFTFEDVLKQALVNITFNCFDTNSAISSISNILMESGKTKSDKAKAIERLVDTYTVFDEVNTPDKPQKEQVKEDKKTLKAFANLVLGLSANLIDLFGSVEDIDDDLKKLQIVGDTYDEKRDELAKVWGDEIHIIDDCKSVYDAIILMSIKEPGLTISQSKVKAFDKHKEDLVILKSLLKLDRNVYNEMFKSDKKGLHNYVHYIKQGRTEETSCSREDFYKYTKKIVEGLADSKDKEYILNEIELQTLLPLQRIKDNGVIPYQLHLEELKVILDKCGPKFPFLHTVSDGFSVTEKLIKMLEFRIPYYVGPLNTHHNIDNGGFSWAVRKQAGRVTPWNFEEKIDREKSAAAFIKNLTNKCTYLFGEDVLPKSSLLYSEFMLLNELNNVRIDGKALAQGVKQHLIDSIFKQDHKKMTKNRIELFLKDNNYITKKHKPEITGLDGEIKNDLTSYRDMVRILGNNFDVSMAEDIITDITIFGESKKMLRQTLRNKFGSQLNDETIKKLSKLRYRDWGRLSKKLLKGIDGCDKAGNGAPKTIIELMRNDSYNLMEILGDKFSFMECIEEENAKLAQGQVVNPHDIIDELALSPAVKRAVWQALRIVDEVAHIKKALPSRIFVEVARTNKSEKKKKDSRQKRLSDLYSAIKKDDVLQSGLQDKEFGALKSGLANYDDAALRSKKLYLYYTQMGRCAYTGNIIDLNQLNTDNYDIDHIYPRSLTKDDSFDNLVLCERTANAKKSDIYPIDNRIQTKQKPFWAFLKHQGLISERKYERLTRIAPLTADDLSGFIARQLVETNQSVKATTTLLRRLYPDIDVVFVKAENVSDFRHNNNFIKVRSLNHHHHAKDAYLNIVVGNVYHEKFTRNFRLFFKKNGANRTYNLAKMFNYDVICTNAQDGKAWDVKTSMNTVKKMMASNDVRVTRRLLEQSGALADATIYKASVAAKAKDGAYIGMKTKYSVFADVTKYGGMTKIKNAYSIIVQYTGKKGEEIKEIVPLPIYLINRNATDIELIDYVKSVIPKAKDISIKYRKLCINQLVKVNGFYYYLGGKTNDKIYIDNAIELVVPHDIATYIKLLDKYDLLRKENKTLKASSITTSIYNINTSTVVSLNKVGIDVFDYFMSKLRTPLYMKMKGNKVDELSSTGRSKFIKMTLEEQSIYLLEVLNLLTNSKTTFDVKPLGITGSRSTIGVKIHNLDEFKIINESITGLYSNEVTIV

SEQ ID NO: 12 - protein, 1363 aa, Lactobacillus rhamnosus GG
MTKLNQPYGIGLDIGSNSIGFAVVDANSHLLRLKGETAIGARLFREGQSAADRRGSRTTRRRLSRTRWRLSFLRDFFAPHITKIDPDFFLRQKYSEISPKDKDRFKYEKRLFNDRTDAEFYEDYPSMYHLRLHLMTHTHKADPREIFLAIHHILKSRGHFLTPGAAKDFNTDKVDLEDIFPALTEAYAQVYPDLELTFDLAKADDFKAKLLDEQATPSDTQKALVNLLLSSDGEKEIVKKRKQVLTEFAKAITGLKTKFNLALGTEVDEADASNWQFSMGQLDDKWSNIETSMTDQGTEIFEQIQELYRARLLNGIVPAGMSLSQAKVADYGQHKEDLELFKTYLKKLNDHELAKTIRGLYDRYINGDDAKPFLREDFVKALTKEVTAHPNEVSEQLLNRMGQANFMLKQRTKANGAIPIQLQQRELDQIIANQSKYYDWLAAPNPVEAHRWKMPYQLDELLNFHIPYYVGPLITPKQQAESGENVFAWMVRKDPSGNITPYNFDEKVDREASANTFIQRMKTTDTYLIGEDVLPKQSLLYQKYEVLNELNNVRINNECLGTDQKQRLIREVFERHSSVTIKQVADNLVAHGDFARRPEIRGLADEKRFLSSLSTYHQLKEILHEAIDDPTKLLDIENIITWSTVFEDHTIFETKLAEIEWLDPKKINELSGIRYRGWGQFSRKLLDGLKLGNGHTVIQELMLSNHNLMQILADETLKETMTELNQDKLKTDDIEDVINDAYTSPSNKKALRQVLRVVEDIKHAANGQDPSWLFIETADGTGTAGKRTQSRQKQIQTVYANAAQELIDSAVRGELEDKIADKASFTDRLVLYFMQGGRDIYTGAPLNIDQLSHYDIDHILPQSLIKDDSLDNRVLVNATINREKNNVFASTLFAGKMKATWRKWHEAGLISGRKLRNLMLRPDEIDKFAKGFVARQLVETRQIIKLTEQIAAAQYPNTKIIAVKAGLSHQLREELDFPKNRDVNHYHHAFDAFLAARIGTYLLKRYPKLAPFFTYGEFAKVDVKKFREFNFIGALTHAKKNIIAKDTGEIVWDKERDIRELDRIYNFKRMLITHEVYFETADLFKQTIYAAKDSKERGGSKQLIPKKQGYPTQVYGGYTQESGSYNALVRVAEADTTAYQVIKISAQNASKIASANLKSREKGKQLLNEIVVKQLAKRRKNWKPSANSFKIVIPRFGMGTLFQNAKYGLFMVNSDTYYRNYQELWLSRENQKLLKKLFSIKYEKTQMNHDALQVYKAIIDQVEKFFKLYDINQFRAKLSDAIERFEKLPINTDGNKIGKTETLRQILIGLQANGTRSNVKNLGIKTDLGLLQVGSGIKLDKDTQIVYQSPSGLFKRRIPLADL

SEQ ID NO: 13 - protein, 1365 aa, Filifactor alocis ATCC 35896
MTKEYYLGLDVGTNSVGWAVTDSQYNLCKFKKKDMWGIRLFESANTAKDRRLQRGNRRRLERKKQRIDLLQEIFSPEICKIDPTFFIRLNESRLHLEDKSNDFKYPLFIEKDYSDIEYYKEFPTIFHLRKHLIESEEKQDIRLIYLALHNIIKTRGHFLIDGDLQSAKQLRPILDTFLLSLQEEQNLSVSLSENQKDEYEEILKNRSIAKSEKVKKLKNLFEISDELEKEEKKAQSAVIENFCKFIVGNKGDVCKFLRVSKEELEIDSFSFSEGKYEDDIVKNLEEKVPEKVYLFEQMKAMYDWNILVDILETEEYISFAKVKQYEKHKTNLRLLRDIILKYCTKDEYNRMFNDEKEAGSYTAYVGKLKKNNKKYWIEKKRNPEEFYKSLGKLLDKIEPLKEDLEVLTMMIEECKNHTLLPIQKNKDNGVIPHQVHEVELKKILENAKKYYSFLTETDKDGYSVVQKIESIFRFRIPYYVGPLSTRHQEKGSNVWMVRKPGREDRIYPWNMEEIIDFEKSNENFITRMTNKCTYLIGEDVLPKHSLLYSKYMVLNELNNVKVRGKKLPTSLKQKVFEDLFENKSKVTGKNLLEYLQIQDKDIQIDDLSGFDKDFKTSLKSYLDFKKQIFGEEIEKESIQNMIEDIIKWITIYGNDKEMLKRVIRANYSNQLTEEQMKKITGFQYSGWGNFSKMFLKGISGSDVSTGETFDIITAMWETDNNLMQILSKKFTFMDNVEDFNSGKVGKIDKITYDSTVKEMFLSPENKRAVWQTIQVAEEIKKVMGCEPKKIFIEMARGGEKVKKRTKSRKAQLLELYAACEEDCRELIKEIEDRDERDFNSMKLFLYYTQFGKCMYSGDDIDINELIRGNSKWDRDHIYPQSKIKDDSIDNLVLVNKTYNAKKSNELLSEDIQKKMHSFWLSLLNKKLITKSKYDRLTRKGDFTDEELSGFIARQLVETRQSTKAIADIFKQIYSSEVVYVKSSLVSDFRKKPLNYLKSRRVNDYHHAKDAYLNIVVGNVYNKKFTSNPIQWMKKNRDTNYSLNKVFEHDVVINGEVIWEKCTYHEDTNTYDGGTLDRIRKIVERDNILYTEYAYCEKGELFNATIQNKNGNSTVSLKKGLDVKKYGGYFSANTSYFSLIEFEDKKGDRARHIIGVPIYIANMLEHSPSAFLEYCEQKGYQNVRILVEKIKKNSLLIINGYPLRIRGENEVDTSFKRAIQLKLDQKNYELVRNIEKFLEKYVEKKGNYPIDENRDHITHEKMNQLYEVLLSKMKKFNKKGMADPSDRIEKSKPKFIKLEDLIDKINVINKMLNLLRCDNDTKADLSLIELPKNAGSFVVKKNTIGKSKIILVNQSVTGLYENRREL

SEQ ID NO: 14 - protein, 1389 aa, Oenococcus kitaharae DSM 17330
MARDYSVGLDIGTSSVGWAAIDNKYHLIRAKSKNLIGVRLFDSAVTAEKRRGYRTTRRRLSRRHWRLRLLNDIFAGPLTDFGDENFLARLKYSWVHPQDQSNQAHFAAGLLFDSKEQDKDFYRKYPTIYHLRLALMNDDQKHDLREVYLAIHHLVKYRGHFLIEGDVKADSAFDVHTFADAIQRYAESNNSDENLLGKIDEKKLSAALTDKHGSKSQRAETAETAFDILDLQSKKQIQAILKSVVGNQANLMAIFGLDSSAISKDEQKNYKFSFDDADIDEKIADSEALLSDTEFEFLCDLKAAFDGLTLKMLLGDDKTVSAAMVRRFNEHQKDWEYIKSHIRNAKNAGNGLYEKSKKFDGINAAYLALQSDNEDDRKKAKKIFQDEISSADIPDDVKADFLKKIDDDQFLPIQRTKNNGTIPHQLHRNELEQIIEKQGIYYPFLKDTYQENSHELNKITALINFRVPYYVGPLVEEEQKIADDGKNIPDPTNHWMVRKSNDTITPWNLSQVVDLDKSGRRFIERLTGTDTYLIGEPTLPKNSLLYQKFDVLQELNNIRVSGRRLDIRAKQDAFEHLFKVQKTVSATNLKDFLVQAGYISEDTQIEGLADVNGKNFNNALTTYNYLVSVLGREFVENPSNEELLEEITELQTVFEDKKVLRRQLDQLDGLSDHNREKLSRKHYTGWGRISKKLLTTKIVQNADKIDNQTFDVPRMNQSIIDTLYNTKMNLMEIINNAEDDFGVRAWIDKQNTTDGDEQDVYSLIDELAGPKEIKRGIVQSFRILDDITKAVGYAPKRVYLEFARKTQESHLTNSRKNQLSTLLKNAGLSELVTQVSQYDAAALQNDRLYLYFLQQGKDMYSGEKLNLDNLSNYDIDHIIPQAYTKDNSLDNRVLVSNITNRRKSDSSNYLPALIDKMRPFWSVLSKQGLLSKHKFANLTRTRDFDDMEKERFIARSLVETRQIIKNVASLIDSHFGGETKAVAIRSSLTADMRRYVDIPKNRDINDYHHAFDALLFSTVGQYTENSGLMKKGQLSDSAGNQYNRYIKEWIHAARLNAQSQRVNPFGFVVGSMRNAAPGKLNPETGEITPEENADWSIADLDYLHKVMNFRKITVTRRLKDQKGQLYDESRYPSVLHDAKSKASINFDKHKPVDLYGGFSSAKPAYAALIKFKNKFRLVNVLRQWTYSDKNSEDYILEQIRGKYPKAEMVLSHIPYGQLVKKDGALVTISSATELHNFEQLWLPLADYKLINTLLKTKEDNLVDILHNRLDLPEMTIESAFYKAFDSILSFAFNRYALHQNALVKLQAHRDDFNALNYEDKQQTLERILDALHASPASSDLKKINLSSGFGRLFSPSHFTLADTDEFIFQSVTGLFSTQKTVAQLYQETK

SEQ ID NO: 15 - protein, 1323 aa, Fructobacillus fructosus KCTC 3544
MVYDVGLDIGTGSVGWVALDENGKLARAKGKNLVGVRLFDTAQTAADRRGFRTTRRRLSRRKWRLRLLDELFSAEINEIDSSFFQRLKYSYVHPKDEENKAHYYGGYLFPTEEETKKFHRSYPTIYHLRQELMAQPNKRFDIREIYLAIHHLVKYRGHFLSSQEKITIGSTYNPEDLANAIEVYADEKGLSWELNNPEQLTEIISGEAGYGLNKSMKADEALKLFEFDNNQDKVAIKTLLAGLTGNQIDFAKLFGKDISDKDEAKLWKLKLDDEALEEKSQTILSQLTDEEIELFHAVVQAYDGFVLIGLLNGADSVSAAMVQLYDQHREDRKLLKSLAQKAGLKHKRFSEIYEQLALATDEATIKNGISTARELVEESNLSKEVKEDTLRRLDENEFLPKQRTKANSVIPHQLHLAELQKILQNQGQYYPFLLDTFEKEDGQDNKIEELLRFRIPYYVGPLVTKKDVEHAGGDADNHWVERNEGFEKSRVTPWNFDKVFNRDKAARDFIERLTGNDTYLIGEKTLPQNSLRYQLFTVLNELNNVRVNGKKFDSKTKADLINDLFKARKTVSLSALKDYLKAQGKGDVTITGLADESKFNSSLSSYNDLKKTFDAEYLENEDNQETLEKIIEIQTVFEDSKIASRELSKLPLDDDQVKKLSQTHYTGWGRLSEKLLDSKIIDERGQKVSILDKLKSTSQNFMSIINNDKYGVQAWITEQNTGSSKLTFDEKVNELTTSPANKRGIKQSFAVLNDIKKAMKEEPRRVYLEFAREDQTSVRSVPRYNQLKEKYQSKSLSEEAKVLKKTLDGNKNKMSDDRYFLYFQQQGKDMYTGRPINFERLSQDYDIDHIIPQAFTKDDSLDNRVLVSRPENARKSDSFAYTDEVQKQDGSLWTSLLKSGFINRKKYERLTKAGKYLDGQKTGFIARQLVETRQIIKNVASLIEGEYENSKAVAIRSEITADMRLLVGIKKHREINSFHHAFDALLITAAGQYMQNRYPDRDSTNVYNEFDRYTNDYLKNLRQLSSRDEVRRLKSFGFVVGTMRKGNEDWSEENTSYLRKVMMFKNILTTKKTEKDRGPLNKETIFSPKSGKKLIPLNSKRSDTALYGGYSNVYSAYMTLVRANGKNLLIKIPISIANQIEVGNLKINDYIVNNPAIKKFEKILISKLPLGQLVNEDGNLIYLASNEYRHNAKQLWLSTTDADKIASISENSSDEELLEAYDILTSENVKNRFPFFKKDIDKLSQVRDEFLDSDKRIAVIQTILRGLQIDAAYQAPVKIISKKVSDWHKLQQSGGIKLSDNSEMIYQSATGIFETRVKISDLL

SEQ ID NO: 16 - protein, 1329 aa, Catenibacterium mitsuokai DSM 15897
IVDYCIGLDLGTGSVGWAVVDMNHRLMKRNGKHLWGSRLFSNAETAANRRASRSIRRRYNKRRERIRLLRAILQDMVLEKDPTFFIRLEHTSFLDEEDKAKYLGTDYKDNYNLFIDEDFNDYTYYHKYPTIYHLRKALCESTEKADPRLIYLALHHIVKYRGNFLYEGQKFNMDASNIEDKLSDIFTQFTSFNNIPYEDDEKKNLEILEILKKPLSKKAKVDEVMTLIAPEKDYKSAFKELVTGIAGNKMNVTKMILCEPIKQGDSEIKLKFSDSNYDDQFSEVEKDLGEYVEFVDALHNVYSWVELQTIMGATHTDNASISEAMVSRYNKHHDDLKLLKDCIKNNVPNKYFDMFRNDSEKSKGYYNYINRPSKAPVDEFYKYVKKCIEKVDTPEAKQILNDIELENFLLKQNSRTNGSVPYQMQLDEMIKIIDNQAEYYPILKEKREQLLSILTFRIPYYFGPLNETSEHAWIKRLEGKENQRILPWNYQDIVDVDATAEGFIKRMRSYCTYFPDEEVLPKNSLIVSKYEVYNELNKIRVDDKLLEVDVKNDIYNELFMKNKTVTEKKLKNWLVNNQCCSKDAEIKGFQKENQFSTSLTPWIDFTNIFGKIDQSNFDLIENIIYDLTVFEDKKIMKRRLKKKYALPDDKVKQILKLKYKDWSRLSKKLLDGIVADNRFGSSVTVLDVLEMSRLNLMEIINDKDLGYAQMIEEATSCPEDGKFTYEEVERLAGSPALKRGIWQSLQIVEEITKVMKCRPKYIYIEFERSEEAKERTESKIKKLENVYKDLDEQTKKEYKSVLEELKGFDNTKKISSDSLFLYFTQLGKCMYSGKKLDIDSLDKYQIDHIVPQSLVKDDSFDNRVLVVPSENQRKLDDLVVPFDIRDKMYRFWKLLFDHELISPKKFYSLIKTEYTERDEERFINRQLVETRQITKNVTQIIEDHYSTTKVAAIRANLSHEFRVKNHIYKNRDINDYHHAHDAYIVALIGGFMRDRYPNMHDSKAVYSEYMKMFRKNKNDQKRWKDGFVINSMNYPYEVDGKLIWNPDLINEIKKCFYYKDCYCTTKLDQKSGQLFNLTVLSNDAHADKGVTKAVVPVNKNRSDVHKYGGFSGLQYTIVAIEGQKKKGKKTELVKKISGVPLHLKAASINEKINYIEEKEGLSDVRIIKDNIPVNQMIEMDGGEYLLTSPTEYVNARQLVLNEKQCALIADIYNAIYKQDYDNLDDILMIQLYIELTNKMKVLYPAYRGIAEKFESMNENYVVISKEEKANIIKQMLIVMHRGPQNGNIVYDDFKISDRIGRLKTKNHNLNNIVFISQSPTGIYTKKYKL

SEQ ID NO: 17 - protein, 1348 aa, Finegoldia magna ATCC 29328
MKSEKKYYIGLDVGTNSVGWAVTDEFYNILRAKGKDLWGVRLFEKADTAANTRIFRSGRRRNDRKGMRLQILREIFEDEIKKVDKDFYDRLDESKFWAEDKKVSGKYSLFNDKNFSDKQYFEKFPTIFHLRKYLMEEHGKVDIRYYFLAINQMMKRRGHFLIDGQISHVTDDKPLKEQLILLINDLLKIELEEELMDSIFEILADVNEKRTDKKNNLKELIKGQDFNKQEGNILNSIFESIVTGKAKIKNIISDEDILEKIKEDNKEDFVLTGDSYEENLQYFEEVLQENITLFNTLKSTYDFLILQSILKGKSTLSDAQVERYDEHKKDLEILKKVIKKYDEDGKLFKQVFKEDNGNGYVSYIGYYLNKNKKITAKKKISNIEFTKYVKGILEKQCDCEDEDVKYLLGKIEQENFLLKQISSINSVIPHQIHLFELDKILENLAKNYPSFNNKKEEFTKIEKIRKTFTFRIPYYVGPLNDYHKNNGGNAWIFRNKGEKIRPWNFEKIVDLHKSEEEFIKRMLNQCTYLPEETVLPKSSILYSEYMVLNELNNLRINGKPLDTDVKLKLIEELFKKKTKVTLKSIRDYMVRNNFADKEDFDNSEKNLEIASNMKSYIDFNNILEDKFDVEMVEDLIEKITIHTGNKKLLKKYIEETYPDLSSSQIQKIINLKYKDWGRLSRKLLDGIKGTKKETEKTDTVINFLRNSSDNLMQIIGSQNYSFNEYIDKLRKKYIPQEISYEVVENLYVSPSVKKMIWQVIRVTEEITKVMGYDPDKIFIEMAKSEEEKKTTISRKNKLLDLYKAIKKDERDSQYEKLLTGLNKLDDSDLRSRKLYLYYTQMGRDMYTGEKIDLDKLFDSTHYDKDHIIPQSMKKDDSIINNLVLVNKNANQTTKGNIYPVPSSIRNNPKIYNYWKYLMEKEFISKEKYNRLIRNTPLTNEELGGFINRQLVETRQSTKAIKELFEKFYQKSKIIPVKASLASDLRKDMNTLKSREVNDLHHAHDAFLNIVAGDVWNREFTSNPINYVKENREGDKVKYSLSKDFTRPRKSKGKVIWTPEKGRKLIVDTLNKPSVLISNESHVKKGELFNATIAGKKDYKKGKIYLPLKKDDRLQDVSKYGGYKAINGAFFFLVEHTKSKKRIRSIELFPLHLLSKFYEDKNTVLDYAINVLQLQDPKIIIDKINYRTEIIIDNFSYLISTKSNDGSITVKPNEQMYWRVDEISNLKKIENKYKKDAILTEEDRKIMESYIDKIYQQFKAGKYKNRRTTDTIIEKYEIIDLDTLDNKQLYQLLVAFISLSYKTSNNAVDFTVIGLGTECGKPRITNLPDNTYLVYKSITGIYEKRIRIK

SEQ ID NO: 18 - protein, 1384 aa, CoriobacteriumglomeransPW2
MKLRGIEDDYSIGLDMGTSSVGWAVTDERGTLAHFKRKPTWGSRLFREAQTAAVARMPRGQRRRYVRRRWRLDLLQKLFEQQMEQADPDFFIRLRQSRLLRDDRAEEHADYRWPLFNDCKFTERDYYQRFPTIYHVRSWLMETDEQADIRLIYLALHNIVKHRGNFLREGQSLSAKSARPDEALNHLRETLRVWSSERGFECSIADNGSILAMLTHPDLSPSDRRKKIAPLFDVKSDDAAADKKLGIALAGAVIGLKTEFKNIFGDFPCEDSSIYLSNDEAVDAVRSACPDDCAELFDRLCEVYSAYVLQGLLSYAPGQTISANMVEKYRRYGEDLALLKKLVKIYAPDQYRMFFSGATYPGTGIYDAAQARGYTKYNLGPKKSEYKPSESMQYDDFRKAVEKLFAKTDARADERYRMMMDRFDKQQFLRRLKTSDNGSIYHQLHLEELKAIVENQGRFYPFLKRDADKLVSLVSFRIPYYVGPLSTRNARTDQHGENRFAWSERKPGMQDEPIFPWNWESIIDRSKSAEKFILRMTGMCTYLQQEPVLPKSSLLYEEFCVLNELNGAHWSIDGDDEHRFDAADREGIIEELFRRKRTVSYGDVAGWMERERNQIGAHVCGGQGEKGFESKLGSYIFFCKDVFKVERLEQSDYPMIERIILWNTLFEDRKILSQRLKEEYGSRLSAEQIKTICKKRFTGWGRLSEKFLTGITVQVDEDSVSIMDVLREGCPVSGKRGRAMVMMEILRDEELGFQKKVDDFNRAFFAENAQALGVNELPGSPAVRRSLNQSIRIVDEIASIAGKAPANIFIEVTRDEDPKKKGRRTKRRYNDLKDALEAFKKEDPELWRELCETAPNDMDERLSLYFMQRGKCLYSGRAIDIHQLSNAGIYEVDHIIPRTYVKDDSLENKALVYREENQRKTDMLLIDPEIRRRMSGYWRMLHEAKLIGDKKFRNLLRSRIDDKALKGFIARQLVETGQMVKLVRSLLEARYPETNIISVKASISHDLRTAAELVKCREANDFHHAHDAFLACRVGLFIQKRHPCVYENPIGLSQVVRNYVRQQADIFKRCRTIPGSSGFIVNSFMTSGFDKETGEIFKDDWDAEAEVEGIRRSLNFRQCFISRMPFEDHGVFWDATIYSPRAKKTAALPLKQGLNPSRYGSFSREQFAYFFIYKARNPRKEQTLFEFAQVPVRLSAQIRQDENALERYARELAKDQGLEFIRIERSKILKNQLIEIDGDRLCITGKEEVRNACELAFAQDEMRVIRMLVSEKPVSRECVISLFNRILLHGDQASRRLSKQLKLALLSEAFSEASDNVQRNVVLGLIAIFNGSTNMVNLSDIGGSKFAGNVRIKYKKELASPKVNVHLIDQSVTGMFERRTKIGL

SEQ ID NO: 19 - protein, 1391 aa, Eubacterium yurii ATCC 43715
MENKQYYIGLDVGTNSVGWAVTDTSYNLLRAKGKDMWGARLFEKANTAAERRTKRTSRRRSEREKARKAMLKELFADEINRVDPSFFIRLEESKFFLDDRSENNRQRYTLFNDATFTDKDYYEKYKTIFHLRSALINSDEKFDVRLVFLAILNLFSHRGHFLNASLKGDGDIQGMDVFYNDLVESCEYFEIELPRITNIDNFEKILSQKGKSRTKILEELSEELSISKKDKSKYNLIKLISGLEASVVELYNIEDIQDENKKIKIGFRESDYEESSLKVKEIIGDEYFDLVERAKSVHDMGLLSNIIGNSKYLCEARVEAYENHHKDLLKIKELLKKYDKKAYNDMFRKMTDKNYSAYVGSVNSNIAKERRSVDKRKIEDLYKYIEDTALKNIPDDNKDKIEILEKIKLGEFLKKQLTASNGVIPNQLQSRELRAILKKAENYLPFLKEKGEKNLTVSEMIIQLFEFQIPYYVGPLDKNPKKDNKANSWAKIKQGGRILPWNFEDKVDVKGSRKEFIEKMVRKCTYISDEHTLPKQSLLYEKFMVLNEINNIKIDGEKISVEAKQKIYNDLFVKGKKVSQKDIKKELISLNIMDKDSVLSGTDTVCNAYLSSIGKFTGVFKEEINKQSIVDMIEDIIFLKTVYGDEKRFVKEEIVEKYGDEIDKDKIKRILGFKFSNWGNLSKSFLELEGADVGTGEVRSIIQSLWETNFNLMELLSSRFTYMDELEKRVKKLEKPLSEWTIEDLDDMYLSSPVKRMIWQSMKIVDEIQTVIGYAPKRIFVEMTRSEGEKVRTKSRKDRLKELYNGIKEDSKQWVKELDSKDESYFRSKKMYLYYLQKGRCMYSGEVIELDKLMDDNLYDIDHIYPRSFVKDDSLDNLVLVKKEINNRKQNDPITPQIQASCQGFWKILHDQGFMSNEKYSRLTRKTQEFSDEEKLSFINRQIVETGQATKCMAQILQKSMGEDVDVVFSKARLVSEFRHKFELFKSRLINDFHHANDAYLNIVVGNSYFVKFTRNPANFIKDARKNPDNPVYKYHMDRFFERDVKSKSEVAWIGQSEGNSGTIVIVKKTMAKNSPLITKKVEEGHGSITKETIVGVKEIKFGRNKVEKADKTPKKPNLQAYRPIKTSDERLCNILRYGGRTSISISGYCLVEYVKKRKTIRSLEAIPVYLGRKDSLSEEKLLNYFRYNLNDGGKDSVSDIRLCLPFISTNSLVKIDGYLYYLGGKNDDRIQLYNAYQLKMKKEEVEYIRKIEKAVSMSKFDEIDREKNPVLTEEKNIELYNKIQDKFENTVFSKRMSLVKYNKKDLSFGDFLKNKKSKFEEIDLEKQCKVLYNIIFNLSNLKEVDLSDIGGSKSTGKCRCKKNITNYKEFKLIQQSITGLYSCEKDLMTI

SEQ ID NO: 20 - protein, 1364 aa, Peptoniphilus duerdenii ATCC BAA1640
MKNLKEYYIGLDIGTASVGWAVTDESYNIPKFNGKKMWGVRLFDDAKTAEERRTQRGSRRRLNRRKERINLLQDLFATEISKVDPNFFLRLDNSDLYREDKDEKLKSKYTLFNDKDFKDRDYHKKYPTIHHLIMDLIEDEGKKDIRLLYLACHYLLKNRGHFIFEGQKFDTKNSFDKSINDLKIHLRDEYNIDLEFNNEDLIEIITDTTLNKTNKKKELKNIVGDTKFLKAISAIMIGSSQKLVDLFEDGEFEETTVKSVDFSTTAFDDKYSEYEEALGDTISLLNILKSIYDSSILENLLKDADKSKDGNKYISKAFVKKFNKHGKDLKTLKRIIKKYLPSEYANIFRNKSINDNYVAYTKSNITSNKRTKASKFTKQEDFYKFIKKHLDTIKETKLNSSENEDLKLIDEMLTDIEFKTFIPKLKSSDNGVIPYQLKLMELKKILDNQSKYYDFLNESDEYGTVKDKVESIMEFRIPYYVGPLNPDSKYAWIKRENTKITPWNFKDIVDLDSSREEFIDRLIGRCTYLKEEKVLPKASLIYNEFMVLNELNNLKLNEFLITEEMKKAIFEELFKTKKKVTLKAVSNLLKKEFNLTGDILLSGTDGDFKQGLNSYIDFKNIIGDKVDRDDYRIKIEEIIKLIVLYEDDKTYLKKKIKSAYKNDFTDDEIKKIAALNYKDWGRLSKRFLTGIEGVDKTTGEKGSIIYFMREYNLNLMELMSGHYTFTEEVEKLNPVENRELCYEMVDELYLSPSVKRMLWQSLRVVDEIKRIIGKDPKKIFIEMARAKEAKNSRKESRKNKLLEFYKFGKKAFINEIGEERYNYLLNEINSEEESKFRWDNLYLYYTQLGRCMYSLEPIDLADLKSNNIYDQDHIYPKSKIYDDSLENRVLVKKNLNHEKGNQYPIPEKVLNKNAYGFWKILFDKGLIGQKKYTRLTRRTPFEERELAEFIERQIVETRQATKETANLLKNICQDSEIVYSKAENASRFRQEFDIIKCRTVNDLHHMHDAYLNIVVGNVYNTKFTKNPLNFIKDKDNVRSYNLENMFKYDVVRGSYTAWIADDSEGNVKAATIKKVKRELEGKNYRFTRMSYIGTGGLYDQNLMRKGKGQIPQKENTNKSNIEKYGGYNKASSAYFALIESDGKAGRERTLETIPIMVYNQEKYGNTEAVDKYLKDNLELQDPKILKDKIKINSLIKLDGFLYNIKGKTGDSLSIAGSVQLIVNKEEQKLIKKMDKFLVKKKDNKDIKVTSFDNIKEEELIKLYKTLSDKLNNGIYSNKRNNQAKNISEALDKFKEISIEEKIDVLNQIILLFQSYNNGCNLKSIGLSAKTGVVFIPKKLNYKECKLINQSITGLFENEVDLLNL

SEQ ID NO: 21 - protein, 1358 aa, Acidaminococcus sp. D21
MGKMYYLGLDIGTNSVGYAVTDPSYHLLKFKGEPMWGAHVFAAGNQSAERRSFRTSRRRLDRRQQRVKLVQEIFAPVISPIDPRFFIRLHESALWRDDVAETDKHIFFNDPTYTDKEYYSDYPTIHHLIVDLMESSEKHDPRLVYLAVAWLVAHRGHFLNEVDKDNIGDVLSFDAFYPEFLAFLSDNGVSPWVCESKALQATLLSRNSVNDKYKALKSLIFGSQKPEDNFDANISEDGLIQLLAGKKVKVNKLFPQESNDASFTLNDKEDAIEEILGTLTPDECEWIAHIRRLFDWAIMKHALKDGRTISESKVKLYEQHHHDLTQLKYFVKTYLAKEYDDIFRNVDSETTKNYVAYSYHVKEVKGTLPKNKATQEEFCKYVLGKVKNIECSEADKVDFDEMIQRLTDNSFMPKQVSGENRVIPYQLYYYELKTILNKAASYLPFLTQCGKDAISNQDKLLSIMTFRIPYFVGPLRKDNSEHAWLERKAGKIYPWNFNDKVDLDKSEEAFIRRMTNTCTYYPGEDVLPLDSLIYEKFMILNEINNIRIDGYPISVDVKQQVFGLFEKKRRVTVKDIQNLLLSLGALDKHGKLTGIDTTIHSNYNTYHHFKSLMERGVLTRDDVERIVERMTYSDDTKRVRLWLNNNYGTLTADDVKHISRLRKHDFGRLSKMFLTGLKGVHKETGERASILDFMWNTNDNLMQLLSECYTFSDEITKLQEAYYAKAQLSLNDFLDSMYISNAVKRPIYRTLAVVNDIRKACGTAPKRIFIEMARDGESKKKRSVTRREQIKNLYRSIRKDFQQEVDFLEKILENKSDGQLQSDALYLYFAQLGRDMYTGDPIKLEHIKDQSFYNIDHIYPQSMVKDDSLDNKVLVQSEINGEKSSRYPLDAAIRNKMKPLWDAYYNHGLISLKKYQRLTRSTPFTDDEKWDFINRQLVETRQSTKALAILLKRKFPDTEIVYSKAGLSSDFRHEFGLVKSRNINDLHHAKDAFLAIVTGNVYHERFNRRWFMVNQPYSVKTKTLFTHSIKNGNFVAWNGEEDLGRIVKMLKQNKNTIHFTRFSFDRKEGLFDIQPLKASTGLVPRKAGLDVVKYGGYDKSTAAYYLLVRFTLEDKKTQHKLMMIPVEGLYKARIDHDKEFLTDYAQTTISEILQKDKQKVINIMFPMGTRHIKLNSMISIDGFYLSIGGKSSKGKSVLCHAMVPLIVPHKIECYIKAMESFARKFKENNKLRIVEKFDKITVEDNLNLYELFLQKLQHNPYNKFFSTQFDVLTNGRSTFTKLSPEEQVQTLLNILSIFKTCRSSGCDLKSINGSAQAARIMISADLTGLSKKYSDIRLVEQSASGLFVSKSQNLLEYL

SEQ ID NO: 22 - protein, 1356 aa, Lactobacillus farciminis KCTC 3681
MTKKEQPYNIGLDIGTSSVGWAVTNDNYDLLNIKKKNLWGVRLFEEAQTAKETRLNRSTRRRYRRRKNRINWLNEIFSEELAKTDPSFLIRLQNSWVSKKDPDRKRDKYNLFIDGPYTDKEYYREFPTIFHLRKELILNKDKADIRLIYLALHNILKYRGNFTYEHQKFNISNLNNNLSKELIELNQQLIKYDISFPDDCDWNHISDILIGRGNATQKSSNILKDFTLDKETKKLLKEVINLILGNVAHLNTIFKTSLTKDEEKLNFSGKDIESKLDDLDSILDDDQFTVLDAANRIYSTITLNEILNGESYFSMAKVNQYENHAIDLCKLRDMWHTTKNEEAVEQSRQAYDDYINKPKYGTKELYTSLKKFLKVALPTNLAKEAEEKISKGTYLVKPRNSENGVVPYQLNKIEMEKIIDNQSQYYPFLKENKEKLLSILSFRIPYYVGPLQSAEKNPFAWMERKSNGHARPWNFDEIVDREKSSNKFIRRMTVTDSYLVGEPVLPKNSLIYQRYEVLNELNNIRITENLKTNPIGSRLTVETKQRIYNELFKKYKKVTVKKLTKWLIAQGYYKNPILIGLSQKDEFNSTLTTYLDMKKIFGSSFMEDNKNYDQIEELIEWLTIFEDKQILNEKLHSSKYSYTPDQIKKISNMRYKGWGRLSKKILMDITTETNTPQLLQLSNYSILDLMWATNNNFISIMSNDKYDFKNYIENHNLNKNEDQNISDLVNDIHVSPALKRGITQSIKIVQEIVKFMGHAPKHIFIEVTRETKKSEITTSREKRIKRLQSKLLNKANDFKPQLREYLVPNKKIQEELKKHKNDLSSERIMLYFLQNGKSLYSEESLNINKLSDYQVDHILPRTYIPDDSLENKALVLAKENQRKADDLLLNSNVIDRNLERWTYMLNNNMIGLKKFKNLTRRVITDKDKLGFIHRQLVQTSQMVKGVANILDNMYKNQGTTCIQARANLSTAFRKALSGQDDTYHFKHPELVKNRNVNDFHHAQDAYLASFLGTYRLRRFPTNEMLLMNGEYNKFYGQVKELYSKKKKLPDSRKNGFIISPLVNGTTQYDRNTGEIIWNVGFRDKILKIFNYHQCNVTRKTEIKTGQFYDQTIYSPKNPKYKKLIAQKKDMDPNIYGGFSGDNKSSITIVKIDNNKIKPVAIPIRLINDLKDKKTLQNWLEENVKHKKSIQIIKNNVPIGQIIYSKKVGLLSLNSDREVANRQQLILPPEHSALLRLLQIPDEDLDQILAFYDKNILVEILQELITKMKKFYPFYKGEREFLIANIENFNQATTSEKVNSLEELITLLHANSTSAHLIFNNIEKKAFGRKTHGLTLNNTDFIYQSVTGLYETRIHIE

SEQ ID NO: 23 - protein, 1421 aa, Streptococcus sanguinis SK49
MTKFNKNYSIGLDIGVSSVGYAVVTEDYRVPAFKFKVLGNTEKEKIKKNLIGSTTFVSAQPAKGTRVFRVNRRRIDRRNHRITYLRDIFQKEIEKVDKNFYRRLDESFRVLGDKSEDLQIKQPFFGDKELETAYHKKYPTIYHLRKHLADADKNSPVADIREVYMAISHILKYRGHFLTLDKINPNNINMQNSWIDFIESCQEVFDLEISDESKNIADIFKSSENRQEKVKKILPYFQQELLKKDKSIFKQLLQLLFGLKTKFKDCFELEEEPDLNFSKENYDENLENFLGSLEEDFSDVFAKLKVLRDTILLSGMLTYTGATHARFSATMVERYEEHRKDLQRFKFFIKQNLSEQDYLDIFGRKTQNGFDVDKETKGYVGYITNKMVLTNPQKQKTIQQNFYDYISGKITGIEGAEYFLNKISDGTFLRKLRTSDNGAIPNQIHAYELEKIIERQGKDYPFLLENKDKLLSILTFKIPYYVGPLAKGSNSRFAWIKRATSSDILDDNDEDTRNGKIRPWNYQKLINMDETRDAFITNLIGNDIILLNEKVLPKRSLIYEEVMLQNELTRVKYKDKYGKAHFFDSELRQNIINGLFKNNSKRVNAKSLIKYLSDNHKDLNAIEIVSGVEKGKSFNSTLKTYNDLKTIFSEELLDSEIYQKELEEIIKVITVFDDKKSIKNYLTKFFGHLEILDEEKINQLSKLRYSGWGRYSAKLLLDIRDEDTGFNLLQFLRNDEENRNLTKLISDNTLSFEPKIKDIQSKSTIEDDIFDEIKKLAGSPAIKRGILNSIKIVDELVQIIGYPPHNIVIEMARENMTTEEGQKKAKTRKTKLESALKNIENSLLENGKVPHSDEQLQSEKLYLYYLQNGKDMYTLDKTGSPAPLYLDQLDQYEVDHIIPYSFLPIDSIDNKVLTHRENNQQKLNNIPDKETVANMKPFWEKLYNAKLISQTKYQRLTTSERTPDGVLTESMKAGFIERQLVETRQIIKHVARILDNRFSDTKIITLKSQLITNFRNTFHIAKIRELNDYHHAHDAYLAVVVGQTLLKVYPKLAPELIYGHHAHFNRHEENKATLRKHLYSNIMRFFNNPDSKVSKDIWDCNRDLPIIKDVIYNSQINFVKRTMIKKGAFYNQNPVGKFNKQLAANNRYPLKTKALCLDTSIYGGYGPMNSALSIIIIAERFNEKKGKIETVKEFHDIFIIDYEKFNNNPFQFLNDTSENGFLKKNNINRVLGFYRIPKYSLMQKIDGTRMLFESKSNLHKATQFKLTKTQNELFFHMKRLLTKSNLMDLKSKSAIKESQNFILKHKEEFDNISNQLSAFSQKMLGNTTSLKNLIKGYNERKIKEIDIRDETIKYFYDNFIKMFSFVKSGAPKDINDFFDNKCTVARMRPKPDKKLLNATLIHQSITGLYETRIDLSKLGED

SEQ ID NO: 24 - protein, 1338 aa, Coprococcus catus GD7
MKQEYFLGLDMGTGSLGWAVTDSTYQVMRKHGKALWGTRLFESASTAEERRMFRTARRRLDRRNWRIQVLQEIFSEEISKVDPGFFLRMKESKYYPEDKRDAEGNCPELPYALFVDDNYTDKNYHKDYPTIYHLRKMLMETTEIPDIRLVYLVLHHMMKHRGHFLLSGDISQIKEFKSTFEQLIQNIQDEELEWHISLDDAAIQFVEHVLKDRNLTRSTKKSRLIKQLNAKSACEKAILNLLSGGTVKLSDIFNNKELDESERPKVSFADSGYDDYIGIVEAELAEQYYIIASAKAVYDWSVLVEILGNSVSISEAKIKVYQKHQADLKTLKKIVRQYMTKEDYKRVFVDTEEKLNNYSAYIGMTKKNGKKVDLKSKQCTQADFYDFLKKNVIKVIDHKEITQEIESEIEKENFLPKQVTKDNGVIPYQVHDYELKKILDNLGTRMPFIKENAEKIQQLFEFRIPYYVGPLNRVDDGKDGKFTWSVRKSDARIYPWNFTEVIDVEASAEKFIRRMTNKCTYLVGEDVLPKDSLVYSKFMVLNELNNLRLNGEKISVELKQRIYEELFCKYRKVTRKKLERYLVIEGIAKKGVEITGIDGDFKASLTAYHDFKERLTDVQLSQRAKEAIVLNVVLFGDDKKLLKQRLSKMYPNLTTGQLKGICSLSYQGWGRLSKTFLEEITVPAPGTGEVWNIMTALWQTNDNLMQLLSRNYGFTNEVEEFNTLKKETDLSYKTVDELYVSPAVKRQIWQTLKVVKEIQKVMGNAPKRVFVEMAREKQEGKRSDSRKKQLVELYRACKNEERDWITELNAQSDQQLRSDKLFLYYIQKGRCMYSGETIQLDELWDNTKYDIDHIYPQSKTMDDSLNNRVLVKKNYNAIKSDTYPLSLDIQKKMMSFWKMLQQQGFITKEKYVRLVRSDELSADELAGFIERQIVETRQSTKAVATILKEALPDTEIVYVKAGNVSNFRQTYELLKVREMNDLHHAKDAYLNIVVGNAYFVKFTKNAAWFIRNNPGRSYNLKRMFEFDIERSGEIAWKAGNKGSIVTVKKVMQKNNILVTRKAYEVKGGLFDQQIMKKGKGQVPIKGNDERLADIEKYGGYNKAAGTYFMLVKSLDKKGKEIRTIEFVPLYLKNQIEINHESAIQYLAQERGLNSPEILLSKIKIDTLFKVDGFKMWLSGRTGNQLIFKGANQLILSHQEAAILKGVVKYVNRKNENKDAKLSERDGMTEEKLLQLYDTFLDKLSNTVYSIRLSAQIKTLTEKRAKFIGLSNEDQCIVLNEILHMFQCQSGSANLKLIGGPGSAGILVMNNNITACKQISVINQSPTGIYEKEIDLIKL

SEQ ID NO: 25 - protein, 1345 aa, Streptococcus mutans UA159
MKKPYSIGLDIGTNSVGWAVVTDDYKVPAKKMKVLGNTDKSHIEKNLLGALLFDSGNTAEDRRLKRTARRRYTRRRNRILYLQEIFSEEMGKVDDSFFHRLEDSFLVTEDKRGERHPIFGNLEEEVKYHENFPTIYHLRQYLADNPEKVDLRLVYLALAHIIKFRGHFLIEGKFDTRNNDVQRLFQEFLAVYDNTFENSSLQEQNVQVEEILTDKISKSAKKDRVLKLFPNEKSNGRFAEFLKLIVGNQADFKKHFELEEKAPLQFSKDTYEEELEVLLAQIGDNYAELFLSAKKLYDSILLSGILTVTDVGTKAPLSASMIQRYNEHQMDLAQLKQFIRQKLSDKYNEVFSDVSKDGYAGYIDGKTNQEAFYKYLKGLLNKIEGSGYFLDKIEREDFLRKQRTFDNGSIPHQIHLQEMRAIIRRQAEFYPFLADNQDRIEKLLTFRIPYYVGPLARGKSDFAWLSRKSADKITPWNFDEIVDKESSAEAFINRMTNYDLYLPNQKVLPKHSLLYEKFTVYNELTKVKYKTEQGKTAFFDANMKQEIFDGVFKVYRKVTKDKLMDFLEKEFDEFRIVDLTGLDKENKVFNASYGTYHDLCKILDKDFLDNSKNEKILEDIVLTLTLFEDREMIRKRLENYSDLLTKEQVKKLERRHYTGWGRLSAELIHGIRNKESRKTILDYLIDDGNSNRNFMQLINDDALSFKEEIAKAQVIGETDNLNQVVSDIAGSPAIKKGILQSLKIVDELVKIMGHQPENIVVEMARENQFTNQGRRNSQQRLKGLTDSIKEFGSQILKEHPVENSQLQNDRLFLYYLQNGRDMYTGEELDIDYLSQYDIDHIIPQAFIKDNSIDNRVLTSSKENRGKSDDVPSKDVVRKMKSYWSKLLSAKLITQRKFDNLTKAERGGLTDDDKAGFIKRQLVETRQITKHVARILDERFNTETDENNKKIRQVKIVTLKSNLVSNFRKEFELYKVREINDYHHAHDAYLNAVIGKALLGVYPQLEPEFVYGDYPHFHGHKENKATAKKFFYSNIMNFFKKDDVRTDKNGEIIWKKDEHISNIKKVLSYPQVNIVKKVEEQTGGFSKESILPKGNSDKLIPRKTKKFYWDTKKYGGFDSPIVAYSILVIADIEKGKSKKLKTVKALVGVTIMEKMTFERDPVAFLERKGYRNVQEENIIKLPKYSLFKLENGRKRLLASARELQKGNEIVLPNHLGTLLYHAKNIHKVDEPKHLDYVDKHKDEFKELLDVVSNFSKKYTLAEGNLEKIKELYAQNNGEDLKELASSFINLLTFTAIGAPATFKFFDKNIDRKRYTSTTEILNATLIHQSITGLYETRIDLNKLGGD

SEQ ID NO: 26 - protein, 1368 aa, Streptococcus pyogenes M1 GAS [sequence omitted]

SEQ ID NO: 27 - protein, 1388 aa, Streptococcus thermophilus LMD9
MTKPYSIGLDIGTNSVGWAVTTDNYKVPSKKMKVLGNTSKKYIKKNLLGVLLFDSGITAEGRRLKRTARRRYTRRRNRILYLQEIFSTEMATLDDAFFQRLDDSFLVPDDKRDSKYPIFGNLVEEKAYHDEFPTIYHLRKYLADSTKKADLRLVYLALAHMIKYRGHFLIEGEFNSKNNDIQKNFQDFLDTYNAIFESDLSLENSKQLEEIVKDKISKLEKKDRILKLFPGEKNSGIFSEFLKLIVGNQADFRKCFNLDEKASLHFSKESYDEDLETLLGYIGDDYSDVFLKAKKLYDAILLSGFLTVTDNETEAPLSSAMIKRYNEHKEDLALLKEYIRNISLKTYNEVFKDDTKNGYAGYIDGKTNQEDFYVYLKKLLAEFEGADYFLEKIDREDFLRKQRTFDNGSIPYQIHLQEMRAILDKQAKFYPFLAKNKERIEKILTFRIPYYVGPLARGNSDFAWSIRKRNEKITPWNFEDVIDKESSAEAFINRMTSFDLYLPEEKVLPKHSLLYETFNVYNELTKVRFIAESMRDYQFLDSKQKKDIVRLYFKDKRKVTDKDIIEYLHAIYGYDGIELKGIEKQFNSSLSTYHDLLNIINDKEFLDDSSNEAIIEEIIHTLTIFEDREMIKQRLSKFENIFDKSVLKKLSRRHYTGWGKLSAKLINGIRDEKSGNTILDYLIDDGISNRNFMQLIHDDALSFKKKIQKAQIIGDEDKGNIKEVVKSLPGSPAIKKGILQSIKIVDELVKVMGGRKPESIVVEMARENQYTNQGKSNSQQRLKRLEKSLKELGSKILKENIPAKLSKIDNNALQNDRLYLYYLQNGKDMYTGDDLDIDRLSNYDIDHIIPQAFLKDNSIDNKVLVSSASNRGKSDDVPSLEVVKKRKTFWYQLLKSKLISQRKFDNLTKAERGGLSPEDKAGFIQRQLVETRQITKHVARLLDEKFNNKKDENNRAVRTVKIITLKSTLVSQFRKDFELYKVREINDFHHAHDAYLNAVVASALLKKYPKLEPEFVYGDYPKYNSFRERKSATEKVYFYSNIMNIFKKSISLADGRVIERPLIEVNEETGESVWNKESDLATVRRVLSYPQVNVVKKVEEQNHGLDRGKPKGLFNANLSSKPKPNSNENLVGAKEYLDPKKYGGYAGISNSFTVLVKGTIEKGAKKKITNVLEFQGISILDRINYRKDKLNFLLEKGYKDIELIIELPKYSLFELSDGSRRMLASILSTNNKRGEIHKGNQIFLSQKFVKLLYHAKRISNTINENHRKYVENHKKEFEELFYYILEFNENYVGAKKNGKLLNSAFQSWQNHSIDELCSSFIGPTGSERKGLFELTSRGSAADFEFLGVKIPRYRDYTPSSLLKDATLIHQSVTGLYETRIDLAKLGEG

SEQ ID NO: 28 - protein, 1374 aa, Fusobacterium nucleatum ATCC49256
MKKQKFSDYYLGFDIGTNSVGWCVTDLDYNVLRFNKKDMWGSRLFDEAKTAAERRVQRNSRRRLKRRKWRLNLLEEIFSDEIMKIDSNFFRRLKESSLWLEDKNSKEKFTLFNDDNYKDYDFYKQYPTIFHLRDELIKNPEKKDIRLIYLALHSIFKSRGHFLFEGQNLKEIKNFETLYNNLISFLEDNGINKSIDKDNIEKLEKIICDSGKGLKDKEKEFKGIFNSDKQLVAIFKLSVGSSVSLNDLFDTDEYKKEEVEKEKISFREQIYEDDKPIYYSILGEKIELLDIAKSFYDFMVLNNILSDSNYISEAKVKLYEEHKKDLKNLKYIIRKYNKENYDKLFKDKNENNYPAYIGLNKEKDKKEVVEKSRLKIDDLIKVIKGYLPKPERIEEKDKTIFNEILNKIELKTILPKQRISDNGTLPYQIHEVELEKILENQSKYYDFLNYEENGVSTKDKLLKTFKFRIPYYVGPLNSYHKDKGGNSWIVRKEEGKILPWNFEQKVDIEKSAEEFIKRMTNKCTYLNGEDVIPKDSFLYSEYIILNELNKVQVNDEFLNEENKRKIIDELFKENKKVSEKKFKEYLLVNQIANRTVELKGIKDSFNSNYVSYIKFKDIFGEKLNLDIYKEISEKSILWKCLYGDDKKIFEKKIKNEYGDILNKDEIKKINSFKFNTWGRLSEKLLTGIEFINLETGECYSSVMEALRRTNYNLMELLSSKFTLQESIDNENKEMNEVSYRDLIEESYVSPSLKRAILQTLKIYEEIKKITGRVPKKVFIEMARGGDESMKNKKIPARQEQLKKLYDSCGNDIANFSIDIKEMKNSLSSYDNNSLRQKKLYLYYLQFGKCMYTGREIDLDRLLQNNDTYDIDHIYPRSKVIKDDSFDNLVLVLKNENAEKSNEYPVKKEIQEKMKSFWRFLKEKNFISDEKYKRLTGKDDFELRGFMARQLVNVRQTTKEVGKILQQIEPEIKIVYSKAEIASSFREMFDFIKVRELNDTHHAKDAYLNIVAGNVYNTKFTEKPYRYLQEIKENYDVKKIYNYDIKNAWDKENSLEIVKKNMEKNTVNITRFIKEEKGELFNLNPIKKGETSNEIISIKPKLYDGKDNKLNEKYGYYTSLKAAYFIYVEHEKKNKKVKTFERITRIDSTLIKNEKNLIKYLVSQKKLLNPKIIKKIYKEQTLIIDSYPYTFTGVDSNKKVELKNKKQLYLEKKYEQILKNALKFVEDNQGETEENYKFIYLKKRNNNEKNETIDAVKERYNIEFNEMYDKFLEKLSSKDYKNYINNKLYTNFLNSKEKFKKLKLWEKSLILREFLKIFNKNTYGKYEIKDSQTKEKLFSFPEDTGRIRLGQSSLGNNKELLEESVTGLFVKKIKL

SEQ ID NO: 29 - protein, 1333 aa, Planococcus antarcticus DSM 14505
MKNYTIGLDIGVASVGWVCIDENYKILNYNNRHAFGVHEFESAESAAGRRLKRGMRRRYNRRKKRLQLLQSLFDSYITDSGFFSKTDSQHFWKNNNEFENRSLTEVLSSLRISSRKYPTIYHLRSDLIESNKKMDLRLVYLALHNLVKYRGHFLQEGNWSEAASAEGMDDQLLELVTRYAELENLSPLDLSESQWKAAETLLLNRNLTKTDQSKELTAMFGKEYEPFCKLVAGLGVSLHQLFPSSEQALAYKETKTKVQLSNENVEEVMELLLEEESALLEAVQPFYQQVVLYELLKGETYVAKAKVSAFKQYQKDMASLKNLLDKTFGEKVYRSYFISDKNSQREYQKSHKVEVLCKLDQFNKEAKFAETFYKDLKKLLEDKSKTSIGTTEKDEMLRIIKAIDSNQFLQKQKGIQNAAIPHQNSLYEAEKILRNQQAHYPFITTEWIEKVKQILAFRIPYYIGPLVKDTTQSPFSWVERKGDAPITPWNFDEQIDKAASAEAFISRMRKTCTYLKGQEVLPKSSLTYERFEVLNELNGIQLRTTGAESDFRHRLSYEMKCWIIDNVFKQYKTVSTKRLLQELKKSPYADELYDEHTGEIKEVFGTQKENAFATSLSGYISMKSILGAVVDDNPAMTEELIYWIAVFEDREILHLKIQEKYPSITDVQRQKLALVKLPGWGRFSRLLIDGLPLDEQGQSVLDHMEQYSSVFMEVLKNKGFGLEKKIQKMNQHQVDGTKKIRYEDIEELAGSPALKRGIWRSVKIVEELVSIFGEPANIVLEVAREDGEKKRTKSRKDQWEELTKTTLKNDPDLKSFIGEIKSQGDQRFNEQRFWLYVTQQGKCLYTGKALDIQNLSMYEVDHILPQNFVKDDSLDNLALVMPEANQRKNQVGQNKMPLEIIEANQQYAMRTLWERLHELKLISSGKLGRLKKPSFDEVDKDKFIARQLVETRQIIKHVRDLLDERFSKSDIHLVKAGIVSKFRRFSEIPKIRDYNNKHHAMDALFAAALIQSILGKYGKNFLAFDLSKKDRQKQWRSVKGSNKEFFLFKNFGNLRLQSPVTGEEVSGVEYMKHVYFELPWQTTKMTQTGDGMFYKESIFSPKVKQAKYVSPKTEKFVHDEVKNHSICLVEFTFMKKEKEVQETKFIDLKVIEHHQFLKEPESQLAKFLAEKETNSPIIHARIIRTIPKYQKIWIEHFPYYFISTRELHNARQFEISYELMEKVKQLSERSSVEELKIVFGLLIDQMNDNYPIYTKSSIQDRVQKFVDTQLYDFKSFEIGFEELKKAVAANAQRSDTFGSRISKKPKPEEVAIGYESITGLKYRKPRSVVGTKR

SEQ ID NO: 30 - protein, 1395 aa, Treponema denticola ATCC 35405
MKKEIKDYFLGLDVGTGSVGWAVTDTDYKLLKANRKDLWGMRCFETAETAEVRRLHRGARRRIERRKKRIKLLQELFSQEIAKTDEGFFQRMKESPFYAEDKTILQENTLFNDKDFADKTYHKAYPTINHLIKAWIENKVKPDPRLLYLACHNIIKKRGHFLFEGDFDSENQFDTSIQALFEYLREDMEVDIDADSQKVKEILKDSSLKNSEKQSRLNKILGLKPSDKQKKAITNLISGNKINFADLYDNPDLKDAEKNSISFSKDDFDALSDDLASILGDSFELLLKAKAVYNCSVLSKVIGDEQYLSFAKVKIYEKHKTDLTKLKNVIKKHFPKDYKKVFGYNKNEKNNNNYSGYVGVCKTKSKKLIINNSVNQEDFYKFLKTILSAKSEIKEVNDILTEIETGTFLPKQISKSNAEIPYQLRKMELEKILSNAEKHFSFLKQKDEKGLSHSEKIIMLLTFKIPYYIGPINDNHKKFFPDRCWVVKKEKSPSGKTTPWNFFDHIDKEKTAEAFITSRTNFCTYLVGESVLPKSSLLYSEYTVLNEINNLQIIIDGKNICDIKLKQKIYEDLFKKYKKITQKQISTFIKHEGICNKTDEVIILGIDKECTSSLKSYIELKNIFGKQVDEISTKNMLEEIIRWATIYDEGEGKTILKTKIKAEYGKYCSDEQIKKILNLKFSGWGRLSRKFLETVTSEMPGFSEPVNIITAMRETQNNLMELLSSEFTFTENIKKINSGFEDAEKQFSYDGLVKPLFLSPSVKKMLWQTLKLVKEISHITQAPPKKIFIEMAKGAELEPARTKTRLKILQDLYNNCKNDADAFSSEIKDLSGKIENEDNLRLRSDKLYLYYTQLGKCMYCGKPIEIGHVFDTSNYDIDHIYPQSKIKDDSISNRVLVCSSCNKNKEDKYPLKSEIQSKQRGFWNFLQRNNFISLEKLNRLTRATPISDDETAKFIARQLVETRQATKVAAKVLEKMFPETKIVYSKAETVSMFRNKFDIVKCREINDFHHAHDAYLNIVVGNVYNTKFTNNPWNFIKEKRDNPKIADTYNYYKVFDYDVKRNNITAWEKGKTIITVKDMLKRNTPIYTRQAACKKGELFNQTIMKKGLGQHPLKKEGPFSNISKYGGYNKVSAAYYTLIEYEEKGNKIRSLETIPLYLVKDIQKDQDVLKSYLTDLLGKKEFKILVPKIKINSLLKINGFPCHITGKTNDSFLLRPAVQFCCSNNEVLYFKKIIRFSEIRSQREKIGKTISPYEDLSFRSYIKENLWKKTKNDEIGEKEFYDLLQKKNLEIYDMLLTKHKDTIYKKRPNSATIDILVKGKEKFKSLIIENQFEVILEILKLFSATRNVSDLQHIGGSKYSGVAKIGNKISSLDNCILIYQSITGIFEKRIDLLKV

SEQ ID NO: 31 - protein, 1327 aa, Solobacterium moorei F0204
MEGQMKNNGNNLQQGNYYLGLDVGTSSVGWAVTDTDYNVLKFRGKSMWGARLFDEASTAEERRTHRGNRRRLARRKYRLLLLEQLFEKEIRKIDDNFFVRLHESNLWADDKSKPSKFLLFNDTNFTDKDYLKKYPTIYHLRSDLIHNSTEHDIRLVFLALHHLIKYRGHFIYDNSANGDVKTLDEAVSDFEEYLNENDIEFNIENKKEFINVLSDKHLTKKEKKISLKKLYGDITDSENINISVLIEMLSGSSISLSNLFKDIEFDGKQNLSLDSDIEETLNDVVDILGDNIDLLIHAKEVYDIAVLTSSLGKHKYLCDAKVELFEKNKKDLMILKKYIKKNHPEDYKKIFSSPTEKKNYAAYSQTNSKNVCSQEEFCLFIKPYIRDMVKSENEDEVRIAKEVEDKSFLTKLKGTNNSVVPYQIHERELNQILKNIVAYLPFMNDEQEDISVVDKIKLIFKFKIPYYVGPLNTKSTRSWVYRSDEKIYPWNFSNVIDLDKTAHEFMNRLIGRCTYTNDPVLPMDSLLYSKYNVLNEINPIKVNGKAIPVEVKQAIYTDLFENSKKKVTRKSIYIYLLKNGYIEKEDIVSGIDIEIKSKLKSHHDFTQIVQENKCTPEEIERIIKGILVYSDDKSMLRRWLKNNIKGLSENDVKYLAKLNYKEWGRLSKTLLTDIYTINPEDGEACSILDIMWNTNATLMEILSNEKYQFKQNIENYKAENYDEKQNLHEELDDMYISPAARRSIWQALRIVDEIVDIKKSAPKKIFIEMAREKKSAMKKKRTESRKDTLLELYKSCKSQADGFYDEELFEKLSNESNSRLRRDQLYLYYTQMGRSMYTGKRIDFDKLINDKNTYDIDHIYPRSKIKDDSITNRVLVEKDINGEKTDIYPISEDIRQKMQPFWKILKEKGLINEEKYKRLTRNYELTDEELSSFVARQLVETQQSTKALATLLKKEYPSAKIVYSKAGNVSEFRNRKDKELPKFREINDLHHAKDAYLNIVVGNVYDTKFTEKFFNNIRNENYSLKRVFDFSVPGAWDAKGSTFNTIKKYMAKNNPIIAFAPYEVKGELFDQQIVPKGKGQFPIKQGKDIEKYGGYNKLSSAFLFAVEYKGKKARERSLETVYIKDVELYLQDPIKYCESVLGLKEPQIIKPKILMGSLFSINNKKLVVTGRSGKQYVCHHIYQLSINDEDSQYLKNIAKYLQEEPDGNIERQNILNITSVNNIKLFDVLCTKFNSNTYEIILNSLKNDVNEGREKFSELDILEQCNILLQLLKAFKCNRESSNLEKLNNKKQAGVIVIPHLFTKCSVFKVIHQSITGLFEKEMDLLK

SEQ ID NO: 32 - protein, 1334 aa, Staphylococcus pseudintermedius ED99
MGRKPYILSLDIGTGSVGYACMDKGFNVLKYHDKDALGVYLFDGALTAQERRQFRTSRRRKNRRIKRLGLLQELLAPLVQNPNFYQFQRQFAWKNDNMDFKNKSLSEVLSFLGYESKKYPTIYHLQEALLLKDEKFDPELIYMALYHLVKYRGHFLFDHLKIENLTNNDNMHDFVELIETYENLNNIKLNLDYEKTKVIYEILKDNEMTKNDRAKRVKNMEKKLEQFSIMLLGLKFNEGKLFNHADNAEELKGANQSHTFADNYEENLTPFLTVEQSEFIERANKIYLSLTLQDILKGKKSMAMSKVAAYDKFRNELKQVKDIVYKADSTRTQFKKIFVSSKKSLKQYDATPNDQTFSSLCLFDQYLIRPKKQYSLLIKELKKIIPQDSELYFEAENDTLLKVLNTTDNASIPMQINLYEAETILRNQQKYHAEITDEMIEKVLSLIQFRIPYYVGPLVNDHTASKFGWMERKSNESIKPWNFDEVVDRSKSATQFIRRMTNKCSYLINEDVLPKNSLLYQEMEVLNELNATQIRLQTDPKNRKYRMMPQIKLFAVEHIFKKYKTVSHSKFLEIMLNSNHRENFMNHGEKLSIFGTQDDKKFASKLSSYQDMTKIFGDIEGKRAQIEEIIQWITIFEDKKILVQKLKECYPELTSKQINQLKKLNYSGWGRLSEKLLTHAYQGHSIIELLRHSDENFMEILTNDVYGFQNFIKEENQVQSNKIQHQDIANLTTSPALKKGIWSTIKLVRELTSIFGEPEKIIMEFATEDQQKGKKQKSRKQLWDDNIKKNKLKSVDEYKYIIDVANKLNNEQLQQEKLWLYLSQNGKCMYSGQSIDLDALLSPNATKHYEVDHIFPRSFIKDDSIDNKVLVIKKMNQTKGDQVPLQFIQQPYERIAYWKSLNKAGLISDSKLHKLMKPEFTAMDKEGFIQRQLVETRQISVHVRDFLKEEYPNTKVIPMKAKMVSEFRKKFDIPKIRQMNDAHHAIDAYLNGVVYHGAQLAYPNVDLFDFNFKWEKVREKWKALGEFNTKQKSRELFFFKKLEKMEVSQGERLISKIKLDMNHFKINYSRKLANIPQQFYNQTAVSPKTAELKYESNKSNEVVYKGLTPYQTYVVAIKSVNKKGKEKMEYQMIDHYVFDFYKFQNGNEKELALYLAQRENKDEVLDAQIVYSLNKGDLLYINNHPCYFVSRKEVINAKQFELTVEQQLSLYNVMNNKETNVEKLLIEYDFIAEKVINEYHHYLNSKLKEKRVRTFFSESNQTHEDFIKALDELFKVVTASATRSDKIGSRKNSMTHRAFLGKGKDVKIAYTSISGLKTTKPKSLFKLAESRNEL

SEQ ID NO: 33 - protein, 1472 aa, Flavobacterium branchiophilum FL15
MAKILGLDLGTNSIGWAVVERENIDFSLIDKGVRIFSEGVKSEKGIESSRAAERTGYRSARKIKYRRKLRKYETLKVLSLNRMCPLSIEEVEEWKKSGFKDYPLNPEFLKWLSTDEESNVNPYFFRDRASKHKVSLFELGRAFYHIAQRRGFLSNRLDQSAEGILEEHCPKIEAIVEDLISIDEISTNITDYFFETGILDSNEKNGYAKDLDEGDKKLVSLYKSLLAILKKNESDFENCKSEIIERLNKKDVLGKVKGKIKDISQAMLDGNYKTLGQYFYSLYSKEKIRNQYTSREEHYLSEFITICKVQGIDQINEEEKINEKKFDGLAKDLYKAIFFQRPLKSQKGLIGKCSFEKSKSRCAISHPDFEEYRMWTYLNTIKIGTQSDKKLRFLTQDEKLKLVPKFYRKNDFNFDVLAKELIEKGSSFGFYKSSKKNDFFYWFNYKPTDTVAACQVAASLKNAIGEDWKTKSFKYQTINSNKEQVSRTVDYKDLWHLLTVATSDVYLYEFAIDKLGLDEKNAKAFSKTKLKKDFASLSLSAINKILPYLKEGLLYSHAVFVANIENIVDENIWKDEKQRDYIKTQISEIIENYTLEKSRFEIINGLLKEYKSENEDGKRVYYSKEAEQSFENDLKKKLVLFYKSNEIENKEQQETIFNELLPIFIQQLKDYEFIKIQRLDQKVLIFLKGKNETGQIFCTEEKGTAEEKEKKIKNRLKKLYHPSDIEKFKKKIIKDEFGNEKIVLGSPLTPSIKNPMAMRALHQLRKVLNALILEGQIDEKTIIHIEMARELNDANKRKGIQDYQNDNKKFREDAIKEIKKLYFEDCKKEVEPTEDDILRYQLWMEQNRSEIYEEGKNISICDIIGSNPAYDIEHTIPRSRSQDNSQMNKTLCSQRFNREVKKQSMPIELNNHLEILPRIAHWKEEADNLTREIEIISRSIKAAATKEIKDKKIRRRHYLTLKRDYLQGKYDRFIWEEPKVGFKNSQIPDTGIITKYAQAYLKSYFKKVESVKGGMVAEFRKIWGIQESFIDENGMKHYKVKDRSKHTHHTIDAITIACMTKEKYDVLAHAWTLEDQQNKKEARSIIEASKPWKTFKEDLLKIEEEILVSHYTPDNVKKQAKKIVRVRGKKQFVAEVERDVNGKAVPKKAASGKTIYKLDGEGKKLPRLQQGDTIRGSLHQDSIYGAIKNPLNTDEIKYVIRKDLESIKGSDVESIVDEVVKEKIKEAIANKVLLLSSNAQQKNKLVGTVWMNEEKRIAINKVRIYANSVKNPLHIKEHSLLSKSKHVHKQKVYGQNDENYAMAIYELDGKRDFELINIFNLAKLIKQGQGFYPLHKKKEIKGKIVFVPIEKRNKRDVVLKRGQQVVFYDKEVENPKDISEIVDFKGRIYIIEGLSIQRIVRPSGKVDEYGVIMLRYFKEARKADDIKQDNFKPDGVFKLGENKPTRKMNHQFTAFVEGIDFKVLPSGKFEKI

SEQ ID NO: 34 - protein, 1688 aa, Ignavibacterium album JCM 16511
MEFKKVLGLDIGTNSIGCALLSLPKSIQDYGKGGRLEWLTSRVIPLDADYMKAFIDGKNGLPQVITPAGKRRQKRGSRRLKHRYKLRRSRLIRVFKTLNWLPEDFPLDNPKRIKETISTEGKFSFRISDYVPISDESYREFYREFGYPENEIEQVIEEINFRRKTKGKNKNPMIKLLPEDWVVYYLRKKALIKPTTKEELIRIIYLFNQRRGFKSSRKDLTETAILDYDEFAKRLAEKEKYSAENYETKFVSITKVKEVVELKTDGRKGKKRFKVILEDSRIEPYEIERKEKPDWEGKEYTFLVTQKLEKGKFKQNKPDLPKEEDWALCTTALDNRMGSKHPGEFFFDELLKAFKEKRGYKIRQYPVNRWRYKKELEFIWTKQCQLNPELNNLNINKEILRKLATVLYPSQSKFFGPKIKEFENSDVLHIISEDIIYYQRDLKSQKSLISECRYEKRKGIDGEIYGLKCIPKSSPLYQEFRIWQDIHNIKVIRKESEVNGKKKINIDETQLYINENIKEKLFELFNSKDSLSEKDILELISLNIINSGIKISKKEEETTHRINLFANRKELKGNETKSRYRKVFKKLGFDGEYILNHPSKLNRLWHSDYSNDYADKEKTEKSILSSLGWKNRNGKWEKSKNYDVFNLPLEVAKAIANLPPLKKEYGSYSALAIRKMLVVMRDGKYWQHPDQIAKDQENTSLMLFDKNLIQLTNNQRKVLNKYLLTLAEVQKRSTLIKQKLNEIEHNPYKLELVSDQDLEKQVLKSFLEKKNESDYLKGLKTYQAGYLIYGKHSEKDVPIVNSPDELGEYIRKKLPNNSLRNPIVEQVIRETIFIVRDVWKSFGIIDEIHIELGRELKNNSEERKKTSESQEKNFQEKERARKLLKELLNSSNFEHYDENGNKIFSSFTVNPNPDSPLDIEKFRIWKNQSGLTDEELNKKLKDEKIPTEIEVKKYILWLTQKCRSPYTGKIIPLSKLFDSNVYEIEHIIPRSKMKNDSTNNLVICELGVNKAKGDRLAANFISESNGKCKFGEVEYTLLKYGDYLQYCKDTFKYQKAKYKNLLATEPPEDFIERQINDTRYIGRKLAELLTPVVKDSKNIIFTIGSITSELKITWGLNGVWKDILRPRFKRLESIINKKLIFQDEDDPNKYHFDLSINPQLDKEGLKRLDHRHHALDATIIAATTREHVRYLNSLNAADNDEEKREYFLSLCNHKIRDFKLPWENFTSEVKSKLLSCVVSYKESKPILSDPFNKYLKWEYKNGKWQKVFAIQIKNDRWKAVRRSMFKEPIGTVWIKKIKEVSLKEAIKIQAIWEEVKNDPVRKKKEKYIYDDYAQKVIAKIVQELGLSSSMRKQDDEKLNKFINEAKVSAGVNKNLNTTNKTIYNLEGRFYEKIKVAEYVLYKAKRMPLNKKEYIEKLSLQKMFNDLPNFILEKSILDNYPEILKELESDNKYIIEPHKKNNPVNRLLLEHILEYHNNPKEAFSTEGLEKLNKKAINKIGKPIKYITRLDGDINEEEIFRGAVFETDKGSNVYFVMYENNQTKDREFLKPNPSISVLKAIEHKNKIDFFAPNRLGFSRIILSPGDLVYVPTNDQYVLIKDNSSNETIINWDDNEFISNRIYQVKKFTGNSCYFLKNDIASLILSYSASNGVGEFGSQNISEYSVDDPPIRIKDVCIKIRVDRLGNVRPL

SEQ ID NO: 35 - protein, 1415 aa, Bergeyella zoohelcum ATCC 43767
MKHILGLDLGTNSIGWALIERNIEEKYGKIIGMGSRIVPMGAELSKFEQGQAQTKNADRRTNRGARRLNKRYKQRRNKLIYILQKLDMLPSQIKLKEDFSDPNKIDKITILPISKKQEQLTAFDLVSLRVKALTEKVGLEDLGKIIYKYNQLRGYAGGSLEPEKEDIFDEEQSKDKKNKSFIAFSKIVFLGEPQEEIFKNKKLNRRAIIVETEEGNFEGSTFLENIKVGDSLELLINISASKSGDTITIKLPNKTNWRKKMENIENQLKEKSKEMGREFYISEFLLELLKENRWAKIRNNTILRARYESEFEAIWNEQVKHYPFLENLDKKTLIEIVSFIFPGEKESQKKYRELGLEKGLKYIIKNQVVFYQRELKDQSHLISDCRYEPNEKAIAKSHPVFQEYKVWEQINKLIVNTKIEAGTNRKGEKKYKYIDRPIPTALKEWIFEELQNKKEITFSAIFKKLKAEFDLREGIDFLNGMSPKDKLKGNETKLQLQKSLGELWDVLGLDSINRQIELWNILYNEKGNEYDLTSDRTSKVLEFINKYGNNIVDDNAEETAIRISKIKFARAYSSLSLKAVERILPLVRAGKYFNNDFSQQLQSKILKLLNENVEDPFAKAAQTYLDNNQSVLSEGGVGNSIATILVYDKHTAKEYSHDELYKSYKEINLLKQGDLRNPLVEQIINEALVLIRDIWKNYGIKPNEIRVELARDLKNSAKERATIHKRNKDNQTINNKIKETLVKNKKELSLANIEKVKLWEAQRHLSPYTGQPIPLSDLFDKEKYDVDHIIPISRYFDDSFTNKVISEKSVNQEKANRTAMEYFEVGSLKYSIFTKEQFIAHVNEYFSGVKRKNLLATSIPEDPVQRQIKDTQYIAIRVKEELNKIVGNENVKTTTGSITDYLRNHWGLTDKFKLLLKERYEALLESEKFLEAEYDNYKKDFDSRKKEYEEKEVLFEEQELTREEFIKEYKENYIRYKKNKLIIKGWSKRIDHRHHAIDALIVACTEPAHIKRLNDLNKVLQDWLVEHKSEFMPNFEGSNSELLEEILSLPENERTEIFTQIEKFRAIEMPWKGFPEQVEQKLKEIIISHKPKDKLLLQYNKAGDRQIKLRGQLHEGTLYGISQGKEAYRIPLTKFGGSKFATEKNIQKIVSPFLSGFIANHLKEYNNKKEEAFSAEGIMDLNNKLAQYRNEKGELKPHTPISTVKIYYKDPSKNKKKKDEEDLSLQKLDREKAFNEKLYVKTGDNYLFAVLEGEIKTKKTSQIKRLYDIISFFDATNFLKEEFRNAPDKKTFDKDLLFRQYFEERNKAKLLFTLKQGDFVYLPNENEEVILDKESPLYNQYWGDLKERGKNIYVVQKFSKKQIYFIKHTIADIIKKDVEFGSQNCYETVEGRSIKENCFKLEIDRLGNIVKVIKR

SEQ ID NO: 36 - protein, 1166 aa, Nitrobacter hamburgensis X14
MHVEIDFPHFSRGDSHLAMNKNEILRGSSVLYRLGLDLGSNSLGWFVTHLEKRGDRHEPVALGPGGVRIFPDGRDPQSGTSNAVDRRMARGARKRRDRFVERRKELIAALIKYNLLPDDARERRALEVLDPYALRKTALTDTLPAHHVGRALFHLNQRRGFQSNRKTDSKQSEDGAIKQAASRLATDKGNETLGVFFADMHLRKSYEDRQTAIRAELVRLGKDHLTGNARKKIWAKVRKRLFGDEVLPRADAPHGVRARATITGTKASYDYYPTRDMLRDEFNAIWAGQSAHHATITDEARTEIEHIIFYQRPLKPAIVGKCTLDPATRPFKEDPEGYRAPWSHPLAQRFRILSEARNLEIRDTGKGSRRLTKEQSDLVVAALLANREVKFDKLRTLLKLPAEARFNLESDRRAALDGDQTAARLSDKKGFNKAWRGFPPERQIAIVARLEETEDENELIAWLEKECALDGAAAARVANTTLPDGHCRLGLRAIKKIVPIMQDGLDEDGVAGAGYHIAAKRAGYDHAKLPTGEQLGRLPYYGQWLQDAVVGSGDARDQKEKQYGQFPNPTVHIGLGQLRRVVNDLIDKYGPPTEISIEFTRALKLSEQQKAERQREQRRNQDKNKARAEELAKFGRPANPRNLLKMRLWEELAHDPLDRKCVYTGEQISIERLLSDEVDIDHILPVAMTLDDSPANKIICMRYANRHKRKQTPSEAFGSSPTLQGHRYNWDDIAARATGLPRNKRWRFDANAREEFDKRGGFLARQLNETGWLARLAKQYLGAVTDPNQIWVVPGRLTSMLRGKWGLNGLLPSDNYAGVQDKAEEFLASTDDMEFSGVKNRADHRHHAIDGLVTALTDRSLLWKMANAYDEEHEKFVIEPPWPTMRDDLKAALEKMVVSHKPDHGIEGKLHEDSAYGFVKPLDATGLKEEEAGNLVYRKAIESLNENEVDRIRDIQLRTIVRDHVNVEKTKGVALADALRQLQAPSDDYPQFKHGLRHVRILKKEKGDYLVPIANRASGVAYKAYSAGENFCVEVFETAGGKWDGEAVRRFDANKKNAGPKIAHAPQWRDANEGAKLVMRIHKGDLIRLDHEGRARIMVVHRLDAAAGRFKLADHNETGNLDKRHATNNDIDPFRWLMASYNTLKKLAAVPVRVDELGRVWRVMPN

SEQ ID NO: 37 - protein, 1498 aa, Odoribacter laneus YIT 12061
METTLGIDLGTNSIGLALVDQEEHQILYSGVRIFPEGINKDTIGLGEKEESRNATRRAKRQMRRQYFRKKLRKAKLLELLIAYDMCPLKPEDVRRWKNWDKQQKSTVRQFPDTPAFREWLKQNPYELRKQAVTEDVTRPELGRILYQMIQRRGFLSSRKGKEEGKIFTGKDRMVGIDETRKNLQKQTLGAYLYDIAPKNGEKYRFRTERVRARYTLRDMYIREFEIIWQRQAGHLGLAHEQATRKKNIFLEGSATNVRNSKLITHLQAKYGRGHVLIEDTRITVTFQLPLKEVLGGKIEIEEEQLKFKSNESVLFWQRPLRSQKSLLSKCVFEGRNFYDPVHQKWIIAGPTPAPLSHPEFEEFRAYQFINNIIYGKNEHLTAIQREAVFELMCTESKDFNFEKIPKHLKLFEKFNFDDTTKVPACTTISQLRKLFPHPVWEEKREEIWHCFYFYDDNTLLFEKLQKDYALQTNDLEKIKKIRLSESYGNVSLKAIRRINPYLKKGYAYSTAVLLGGIRNSFGKRFEYFKEYEPEIEKAVCRILKEKNAEGEVIRKIKDYLVHNRFGFAKNDRAFQKLYHHSQAITTQAQKERLPETGNLRNPIVQQGLNELRRTVNKLLATCREKYGPSFKFDHIHVEMGRELRSSKTEREKQSRQIRENEKKNEAAKVKLAEYGLKAYRDNIQKYLLYKEIEEKGGTVCCPYTGKTLNISHTLGSDNSVQIEHIIPYSISLDDSLANKTLCDATFNREKGELTPYDFYQKDPSPEKWGASSWEEIEDRAFRLLPYAKAQRFIRRKPQESNEFISRQLNDTRYISKKAVEYLSAICSDVKAFPGQLTAELRHLWGLNNILQSAPDITFPLPVSATENHREYYVITNEQNEVIRLFPKQGETPRTEKGELLLTGEVERKVFRCKGMQEFQTDVSDGKYWRRIKLSSSVTWSPLFAPKPISADGQIVLKGRIEKGVFVCNQLKQKLKTGLPDGSYWISLPVISQTFKEGESVNNSKLTSQQVQLFGRVREGIFRCHNYQCPASGADGNFWCTLDTDTAQPAFTPIKNAPPGVGGGQIILTGDVDDKGIFHADDDLHYELPASLPKGKYYGIFTVESCDPTLIPIELSAPKTSKGENLIEGNIWVDEHTGEVRFDPKKNREDQRHHAIDAIVIALSSQSLFQRLSTYNARRENKKRGLDSTEHFPSPWPGFAQDVRQSVVPLLVSYKQNPKTLCKISKTLYKDGKKIHSCGNAVRGQLHKETVYGQRTAPGATEKSYHIRKDIRELKTSKHIGKVVDITIRQMLLKHLQENYHIDITQEFNIPSNAFFKEGVYRIFLPNKHGEPVPIKKIRMKEELGNAERLKDNINQYVNPRNNHHVMIYQDADGNLKEEIVSFWSVIERQNQGQPIYQLPREGRNIVSILQINDTFLIGLKEEEPEVYRNDLSTLSKHLYRVQKLSGMYYTFRHHLASTLNNEREEFRIQSLEAWKRANPVKVQIDEIGRITFLNGPLC

SEQ ID NO: 38 - protein, 1372 aa, Legionella pneumophila str. Paris
MESSQILSPIGIDLGGKFTGVCLSHLEAFAELPNHANTKYSVILIDHNNFQLSQAQRRATRHRVRNKKRNQFVKRVALQLFQHILSRDLNAKEETALCHYLNNRGYTYVDTDLDEYIKDETTINLLKELLPSESEHNFIDWFLQKMQSSEFRKILVSKVEEKKDDKELKNAVKNIKNFITGFEKNSVEGHRHRKVYFENIKSDITKDNQLDSIKKKIPSVCLSNLLGHLSNLQWKNLHRYLAKNPKQFDEQTFGNEFLRMLKNFRHLKGSQESLAVRNLIQQLEQSQDYISILEKTPPEITIPPYEARTNTGMEKDQSLLLNPEKLNNLYPNWRNLIPGIIDAHPFLEKDLEHTKLRDRKRIISPSKQDEKRDSYILQRYLDLNKKIDKFKIKKQLSFLGQGKQLPANLIETQKEMETHFNSSLVSVLIQIASAYNKEREDAAQGIWFDNAFSLCELSNINPPRKQKILPLLVGAILSEDFINNKDKWAKFKIFWNTHKIGRTSLKSKCKEIEEARKNSGNAFKIDYEEALNHPEHSNNKALIKIIQTIPDIIQAIQSHLGHNDSQALIYHNPFSLSQLYTILETKRDGFHKNCVAVTCENYWRSQKTEIDPEISYASRLPADSVRPFDGVLARMMQRLAYEIAMAKWEQIKHIPDNSSLLIPIYLEQNRFEFEESFKKIKGSSSDKTLEQAIEKQNIQWEEKFQRIINASMNICPYKGASIGGQGEIDHIYPRSLSKKHFGVIFNSEVNLIYCSSQGNREKKEEHYLLEHLSPLYLKHQFGTDNVSDIKNFISQNVANIKKYISFHLLTPEQQKAARHALFLDYDDEAFKTITKFLMSQQKARVNGTQKFLGKQIMEFLSTLADSKQLQLEFSIKQITAEEVHDHRELLSKQEPKLVKSRQQSFPSHAIDATLTMSIGLKEFPQFSQELDNSWFINHLMPDEVHLNPVRSKEKYNKPNISSTPLFKDSLYAERFIPVWVKGETFAIGFSEKDLFEIKPSNKEKLFTLLKTYSTKNPGESLQELQAKSKAKWLYFPINKTLALEFLHHYFHKEIVTPDDTTVCHFINSLRYYTKKESITVKILKEPMPVLSVKFESSKKNVLGSFKHTIALPATKDWERLFNHPNFLALKANPAPNPKEFNEFIRKYFLSDNNPNSDIPNNGHNIKPQKHKAVRKVFSLPVIPGNAGTMMRIRRKDNKGQPLYQLQTIDDTPSMGIQINEDRLVKQEVLMDAYKTRNLSTIDGINNSEGQAYATFDNWLTLPVSTFKPEIIKLEMKPHSKTRRYIRITQSLADFIKTIDEALMIKPSDSIDDPLNMPNEIVCKNKLFGNELKPRDGKMKIVSTGKIVTYEFESDSTPQWIQTLYVTQLKKQP

SEQ ID NO: 39 - protein, 1517 aa, Bacteroides sp. 20 3
MKKIVGLDLGTNSIGWALINAYINKEHLYGIEACGSRIIPMDAAILGNFDKGNSISQTADRTSYRGIRRLRERHLLRRERLHRILDLLGFLPKHYSDSLNRYGKFLNDIECKLPWVKDETGSYKFIFQESFKEMLANFTEHHPILIANNKKVPYDWTIYYLRKKALTQKISKEELAWILLNFNQKRGYYQLRGEEEETPNKLVEYYSLKVEKVEDSGERKGKDTWYNVHLENGMIYRRTSNIPLDWEGKTKEFIVTTDLEADGSPKKDKEGNIKRSFRAPKDDDWTLIKKKTEADIDKIKMTVGAYIYDTLLQKPDQKIRGKLVRTIERKYYKNELYQILKTQSEFHEELRDKQLYIACLNELYPNNEPRRNSISTRDFCHLFIEDIIFYQRPLKSKKSLIDNCPYEENRYIDKESGEIKHASIKCIAKSHPLYQEFRLWQFIVNLRIYRKETDVDVTQELLPTEADYVTLFEWLNEKKEIDQKAFFKYPPFGFKKTTSNYRWNYVEDKPYPCNETHAQIIARLGKAHIPKAFLSKEKEETLWHILYSIEDKQEIEKALHSFANKNNLSEEFIEQFKNFPPFKKEYGSYSAKAIKKLLPLMRMGKYWSIENIDNGTRIRINKIIDGEYDENIRERVRQKAINLTDITHFRALPLWLACYLVYDRHSEVKDIVKWKTPKDIDLYLKSFKQHSLRNPIVEQVITETLRTVRDIWQQVGHIDEIHIELGREMKNPADKRARMSQQMIKNENTNLRIKALLTEFLNPEFGIENVRPYSPSQQDLLRIYEEGVLNSILELPEDIGIILGKFNQTDTLKRPTRSEILRYKLWLEQKYRSPYTGEMIPLSKLFTPAYEIEHIIPQSRYFDDSLSNKVICESEINKLKDRSLGYEFIKNHHGEKVELAFDKPVEVLSVEAYEKLVHESYSHNRSKMKKLLMEDIPDQFIERQLNDSRYISKVVKSLLSNIVREENEQEAISKNVIPCTGGITDRLKKDWGINDVWNKIVLPRFIRLNELTESTRFTSINTNNTMIPSMPLELQKGFNKKRIDHRHHAMDAIIIACANRNIVNYLNNVSASKNTKITRRDLQTLLCHKDKTDNNGNYKWVIDKPWETFTQDTLTALQKITVSFKQNLRVINKTTNHYQHYENGKKIVSNQSKGDSWAIRKSMHKETVHGEVNLRMIKTVSFNEALKKPQAIVEMDLKKKILAMLELGYDTKRIKNYFEENKDTWQDINPSKIKVYYFTKETKDRYFAVRKPIDTSFDKKKIKESITDTGIQQIMLRHLETKDNDPTLAFSPDGIDEMNRNILILNKGKKHQPIYKVRVYEKAEKFTVGQKGNKRTKFVEAAKGTNLFFAIYETEEIDKDTKKVIRKRSYSTIPLNVVIERQKQGLSSAPEDENGNLPKYILSPNDLVYVPTQEEINKGEVVMPIDRDRIYKMVDSSGITANFIPASTANLIFALPKATAEIYCNGENCIQNEYGIGSPQSKNQKAITGEMVKEICFPIKVDRLGNIIQVGSCILTN

SEQ ID NO: 40 - protein, 1101 aa, Akkermansia muciniphila ATCC BAA835
MSRSLTFSFDIGYASIGWAVIASASHDDADPSVCGCGTVLFPKDDCQAFKRREYRRLRRNIRSRRVRIERIGRLLVQAQIITPEMKETSGHPAPFYLASEALKGHRTLAPIELWHVLRWYAHNRGYDNNASWSNSLSEDGGNGEDTERVKHAQDLMDKHGTATMAETICRELKLEEGKADAPMEVSTPAYKNLNTAFPRLIVEKEVRRILELSAPLIPGLTAEIIELIAQHHPLTTEQRGVLLQHGIKLARRYRGSLLFGQLIPRFDNRIISRCPVTWAQVYEAELKKGNSEQSARERAEKLSKVPTANCPEFYEYRMARILCNIRADGEPLSAEIRRELMNQARQEGKLTKASLEKAISSRLGKETETNVSNYFTLHPDSEEALYLNPAVEVLQRSGIGQILSPSVYRIAANRLRRGKSVTPNYLLNLLKSRGESGEALEKKIEKESKKKEADYADTPLKPKYATGRAPYARTVLKKVVEEILDGEDPTRPARGEAHPDGELKAHDGCLYCLLDTDSSVNQHQKERRLDTMTNNHLVRHRMLILDRLLKDLIQDFADGQKDRISRVCVEVGKELTTFSAMDSKKIQRELTLRQKSHTDAVNRLKRKLPGKALSANLIRKCRIAMDMNWTCPFTGATYGDHELENLELEHIVPHSFRQSNALSSLVLTWPGVNRMKGQRTGYDFVEQEQENPVPDKPNLHICSLNNYRELVEKLDDKKGHEDDRRRKKKRKALLMVRGLSHKHQSQNHEAMKEIGMTEGMMTQSSHLMKLACKSIKTSLPDAHIDMIPGAVTAEVRKAWDVFGVFKELCPEAADPDSGKILKENLRSLTHLHHALDACVLGLIPYIIPAHHNGLLRRVLAMRRIPEKLIPQVRPVANQRHYVLNDDGRMMLRDLSASLKENIREQLMEQRVIQHVPADMGGALLKETMQRVLSVDGSGEDAMVSLSKKKDGKKEKNQVKASKLVGVFPEGPSKLKALKAAIEIDGNYGVALDPKPVVIRHIKVFKRIMALKEQNGGKPVRILKKGMLIHLTSSKDPKHAGVWRIESIQDSKGGVKLDLQRAHCAVPKNKTHECNWREVDLISLLKKYQMKRYPTSYTGTPR

SEQ ID NO: 41 - protein, 1424 aa, Prevotella sp. C561
MTQKVLGLDLGTNSIGSAVRNLDLSDDLQWQLEFFSSDIFRSSVNKESNGREYSLAAQRSAHRRSRGLNEVRRRRLWATLNLLIKHGFCPMSSESLMRWCTYDKRKGLFREYPIDDKDFNAWILLDFNGDGRPDYSSPYQLRRELVTRQFDFEQPIERYKLGRALYHIAQHRGFKSSKGETLSQQETNSKPSSTDEIPDVAGAMKASEEKLSKGLSTYMKEHNLLTVGAAFAQLEDEGVRVRNNNDYRAIRSQFQHEIETIFKFQQGLSVESELYERLISEKKNVGTIFYKRPLRSQRGNVGKCTLERSKPRCAIGHPLFEKFRAWTLINNIKVRMSVDTLDEQLPMKLRLDLYNECFLAFVRTEFKFEDIRKYLEKRLGIHFSYNDKTINYKDSTSVAGCPITARFRKMLGEEWESFRVEGQKERQAHSKNNISFHRVSYSIEDIWHFCYDAEEPEAVLAFAQETLRLERKKAEELVRIWSAMPQGYAMLSQKAIRNINKILMLGLKYSDAVILAKVPELVDVSDEELLSIAKDYYLVEAQVNYDKRINSIVNGLIAKYKSVSEEYRFADHNYEYLLDESDEKDIIRQIENSLGARRWSLMDANEQTDILQKVRDRYQDFFRSHERKFVESPKLGESFENYLTKKFPMVEREQWKKLYHPSQITIYRPVSVGKDRSVLRLGNPDIGAIKNPTVLRVLNTLRRRVNQLLDDGVISPDETRVVVETARELNDANRKWALDTYNRIRHDENEKIKKILEEFYPKRDGISTDDIDKARYVIDQREVDYFTGSKTYNKDIKKYKFWLEQGGQCMYTGRTINLSNLFDPNAFDIEHTIPESLSFDSSDMNLTLCDAHYNRFIKKNHIPTDMPNYDKAITIDGKEYPAITSQLQRWVERVERLNRNVEYWKGQARRAQNKDRKDQCMREMHLWKMELEYWKKKLERFTVTEVTDGFKNSQLVDTRVITRHAVLYLKSIFPHVDVQRGDVTAKFRKILGIQSVDEKKDRSLHSHHAIDATTLTIIPVSAKRDRMLELFAKIEEINKMLSFSGSEDRTGLIQELEGLKNKLQMEVKVCRIGHNVSEIGTFINDNIIVNHHIKNQALTPVRRRLRKKGYIVGGVDNPRWQTGDALRGEIHKASYYGAITQFAKDDEGKVLMKEGRPQVNPTIKFVIRRELKYKKSAADSGFASWDDLGKAIVDKELFALMKGQFPAETSFKDACEQGIYMIKKGKNGMPDIKLHHIRHVRCEAPQSGLKIKEQTYKSEKEYKRYFYAAVGDLYAMCCYTNGKIREFRIYSLYDVSCHRKSDIEDIPEFITDKKGNRLMLDYKLRTGDMILLYKDNPAELYDLDNVNLSRRLYKINRFESQSNLVLMTHHLSTSKERGRSLGKTVDYQNLPESIRSSVKSLNFLIMGENRDFVIKNGKIIFNHR

SEQ ID NO: 42 - protein, 1409 aa, Wolinella succinogenes DSM 1740
MLVSPISVDLGGKNTGFFSFTDSLDNSQSGTVIYDESFVLSQVGRRSKRHSKRNNLRNKLVKRLFLLILQEHHGLSIDVLPDEIRGLFNKRGYTYAGFELDEKKKDALESDTLKEFLSEKLQSIDRDSDVEDFLNQIASNAESFKDYKKGFEAVFASATHSPNKKLELKDELKSEYGENAKELLAGLRVTKEILDEFDKQENQGNLPRAKYFEELGEYIATNEKVKSFFDSNSLKLTDMTKLIGNISNYQLKELRRYFNDKEMEKGDIWIPNKLHKITERFVRSWHPKNDADRQRRAELMKDLKSKEIMELLTTTEPVMTIPPYDDMNNRGAVKCQTLRLNEEYLDKHLPNWRDIAKRLNHGKFNDDLADSTVKGYSEDSTLLHRLLDTSKEIDIYELRGKKPNELLVKTLGQSDANRLYGFAQNYYELIRQKVRAGIWVPVKNKDDSLNLEDNSNMLKRCNHNPPHKKNQIHNLVAGILGVKLDEAKFAEFEKELWSAKVGNKKLSAYCKNIEELRKTHGNTFKIDIEELRKKDPAELSKEEKAKLRLTDDVILNEWSQKIANFFDIDDKHRQRFNNLFSMAQLHTVIDTPRSGFSSTCKRCTAENRFRSETAFYNDETGEFHKKATATCQRLPADTQRPFSGKIERYIDKLGYELAKIKAKELEGMEAKEIKVPIILEQNAFEYEESLRKSKTGSNDRVINSKKDRDGKKLAKAKENAEDRLKDKDKRIKAFSSGICPYCGDTIGDDGEIDHILPRSHTLKIYGTVFNPEGNLIYVHQKCNQAKADSIYKLSDIKAGVSAQWIEEQVANIKGYKTFSVLSAEQQKAFRYALFLQNDNEAYKKVVDWLRTDQSARVNGTQKYLAKKIQEKLTKMLPNKHLSFEFILADATEVSELRRQYARQNPLLAKAEKQAPSSHAIDAVMAFVARYQKVFKDGTPPNADEVAKLAMLDSWNPASNEPLTKGLSTNQKIEKMIKSGDYGQKNMREVFGKSIFGENAIGERYKPIVVQEGGYYIGYPATVKKGYELKNCKVVTSKNDIAKLEKIIKNQDLISLKENQYIKIFSINKQTISELSNRYFNMNYKNLVERDKEIVGLLEFIVENCRYYTKKVDVKFAPKYIHETKYPFYDDWRRFDEAWRYLQENQNKTSSKDRFVIDKSSLNEYYQPDKNEYKLDVDTQPIWDDFCRWYFLDRYKTANDKKSIRIKARKTFSLLAESGVQGKVFRAKRKIPTGYAYQALPMDNNVIAGDYANILLEANSKTLSLVPKSGISIEKQLDKKLDVIKKTDVRGLAIDNNSFFNADFDTHGIRLIVENTSVKVGNFPISAIDKSAKRMIFRALFEKEKGKRKKKTTISFKESGPVQDYLKVFLKKIVKIQLRTDGSISNIVVRKNAADFTLSFRSEHIQKLLK

SEQ ID NO: 43 - protein, 1146 aa, Alicyclobacillus hesperidum URH17368
MAYRLGLDIGITSVGWAVVALEKDESGLKPVRIQDLGVRIFDKAEDSKTGASLALPRREARSARRRTRRRRHRLWRVKRLLEQHGILSMEQIEALYAQRTSSPDVYALRVAGLDRCLIAEEIARVLIHIAHRRGFQSNRKSEIKDSDAGKLLKAVQENENLMQSKGYRTVAEMLVSEATKTDAEGKLVHGKKHGYVSNVRNKAGEYRHTVSRQAIVDEVRKIFAAQRALGNDVMSEELEDSYLKILCSQRNFDDGPGGDSPYGHGSVSPDGVRQSIYERMVGSCTFETGEKRAPRSSYSFERFQLLTKVVNLRIYRQQEDGGRYPCELTQTERARVIDCAYEQTKITYGKLRKLLDMKDTESFAGLTYGLNRSRNKTEDTVFVEMKFYHEVRKALQRAGVFIQDLSIETLDQIGWILSVWKSDDNRRKKLSTLGLSDNVIEELLPLNGSKFGHLSLKAIRKILPFLEDGYSYDVACELAGYQFQGKTEYVKQRLLPPLGEGEVTNPVVRRALSQAIKVVNAVIRKHGSPESIHIELARELSKNLDERRKIEKAQKENQKNNEQIKDEIREILGSAHVTGRDIVKYKLFKQQQEFCMYSGEKLDVTRLFEPGYAEVDHIIPYGISFDDSYDNKVLVKTEQNRQKGNRTPLEYLRDKPEQKAKFIALVESIPLSQKKKNHLLMDKRAIDLEQEGFRERNLSDTRYITRALMNHIQAWLLFDETASTRSKRVVCVNGAVTAYMRARWGLTKDRDAGDKHHAADAVVVACIGDSLIQRVTKYDKFKRNALADRNRYVQQVSKSEGITQYVDKETGEVFTWESFDERKFLPNEPLEPWPFFRDELLARLSDDPSKNIRAIGLLTYSETEQIDPIFVSRMPTRKVTGAAHKETIRSPRIVKVDDNKGTEIQVVVSKVALTELKLTKDGEIKDYFRPEDDPRLYNTLRERLVQFGGDAKAAFKEPVYKISKDGSVRTPVRKVKIQEKLTLGVPVHGGRGIAENGGMVRIDVFAKGGKYYFVPIYVADVLKRELPNRLATAHKPYSEWRVVDDSYQFKFSLYPNDAVMIKPSREVDITYKDRKEPVGCRIMYFVSANIASASISLRTHDNSGELEGLGIQGLEVFEKYVVGPLGDTHPVYKERRMPFRVERKMN

SEQ ID NO: 44 - protein, 1442 aa, Caenispirillum salinarum AK4
MPVLSPLSPNAAQGRRRWSLALDIGEGSIGWAVAEVDAEGRVLQLTGTGVTLFPSAWSNENGTYVAHGAADRAVRGQQQRHDSRRRRLAGLARLCAPVLERSPEDLKDLTRTPPKADPRAIFFLRADAARRPLDGPELFRVLHHMAAHRGIRLAELQEVDPPPESDADDAAPAATEDEDGTRRAAADERAFRRLMAEHMHRHGTQPTCGEIMAGRLRETPAGAQPVTRARDGLRVGGGVAVPTRALIEQEFDAIRAIQAPRHPDLPWDSLRRLVLDQAPIAVPPATPCLFLEELRRRGETFQGRTITREAIDRGLTVDPLIQALRIRETVGNLRLHERITEPDGRQRYVPRAMPELGLSHGELTAPERDTLVRALMHDPDGLAAKDGRIPYTRLRKLIGYDNSPVCFAQERDTSGGGITVNPTDPLMARWIDGWVDLPLKARSLYVRDVVARGADSAALARLLAEGAHGVPPVAAAAVPAATAAILESDIMQPGRYSVCPWAAEAILDAWANAPTEGFYDVTRGLFGFAPGEIVLEDLRRARGALLAHLPRTMAAARTPNRAAQQRGPLPAYESVIPSQLITSLRRAHKGRAADWSAADPEERNPFLRTWTGNAATDHILNQVRKTANEVITKYGNRRGWDPLPSRITVELAREAKHGVIRRNEIAKENRENEGRRKKESAALDTFCQDNTVSWQAGGLPKERAALRLRLAQRQEFFCPYCAERPKLRATDLFSPAETEIDHVIERRMGGDGPDNLVLAHKDCNNAKGKKTPHEHAGDLLDSPALAALWQGWRKENADRLKGKGHKARTPREDKDFMDRVGWRFEEDARAKAEENQERRGRRMLHDTARATRLARLYLAAAVMPEDPAEIGAPPVETPPSPEDPTGYTAIYRTISRVQPVNGSVTHMLRQRLLQRDKNRDYQTHHAEDACLLLLAGPAVVQAFNTEAAQHGADAPDDRPVDLMPTSDAYHQQRRARALGRVPLATVDAALADIVMPESDRQDPETGRVHWRLTRAGRGLKRRIDDLTRNCVILSRPRRPSETGTPGALHNATHYGRREITVDGRTDTVVTQRMNARDLVALLDNAKIVPAARLDAAAPGDTILKEICTEIADRHDRVVDPEGTHARRWISARLAALVPAHAEAVARDIAELADLDALADADRTPEQEARRSALRQSPYLGRAISAKKADGRARAREQEILTRALLDPHWGPRGLRHLIMREARAPSLVRIRANKTDAFGRPVPDAAVWVKTDGNAVSQLWRLTSVVTDDGRRIPLPKPIEKRIEISNLEYARLNGLDEGAGVTGNNAPPRPLRQDIDRLTPLWRDHGTAPGGYLGTAVGELEDKARSALRGKAMRQTLTDAGITAEAGWRLDSEGAVCDLEVAKGDTVKKDGKTYKVGVITQGIFGMPVDAAGSAPRTPEDCEKFEEQYGIKPWKAKGIPLA

SEQ ID NO: 45 - protein, 1114 aa, Eubacterium rectale ATCC 33656
MNYTEKEKLFMKYILALDIGIASVGWAILDKESETVIEAGSNIFPEASAADNQLRRDMRGAKRNNRRLKTRINDFIKLWENNNLSIPQFKSTEIVGLKVRAITEEITLDELYLILYSYLKHRGISYLEDALDDTVSGSSAYANGLKLNAKELETHYPCEIQQERLNTIGKYRGQSQIINENGEVLDLSNVFTIGAYRKEIQRVFEIQKKYHPELTDEFCDGYMLIFNRKRKYYEGPGNEKSRTDYGRFTTKLDANGNYITEDNIFEKLIGKCSVYPDELRAAAASYTAQEYNVLNDLNNLTINGRKLEENEKHEIVERIKSSNTINMRKIISDCMGENIDDFAGARIDKSGKEIFHKFEVYNKMRKALLEIGIDISNYSREELDEIGYIMTINTDKEAMMEAFQKSWIDLSDDVKQCLINMRKTNGALFNKWQSFSLKIMNELIPEMYAQPKEQMTLLTEMGVTKGTQEEFAGLKYIPVDVVSEDIFNPVVRRSVRISFKILNAVLKKYKALDTIVIEMPRDRNSEEQKKRINDSQKLNEKEMEYIEKKLAVTYGIKLSPSDFSSQKQLSLKLKLWNEQDGICLYSGKTIDPNDIINNPQLFEIDHIIPRSISFDDARSNKVLVYRSENQKKGNQTPYYYLTHSHSEWSFEQYKATVMNLSKKKEYAISRKKIQNLLYSEDITKMDVLKGFINRNINDTSYASRLVLNTIQNFFMANEADTKVKVIKGSYTHQMRCNLKLDKNRDESYSHHAVDAMLIGYSELGYEAYHKLQGEFIDFETGEILRKDMWDENMSDEVYADYLYGKKWANIRNEVVKAEKNVKYWHYVMRKSNRGLCNQTIRGTREYDGKQYKINKLDIRTKEGIKVFAKLAFSKKDSDRERLLVYLNDRRTFDDLCKIYEDYSDAANPFVQYEKETGDIIRKYSKKHNGPRIDKLKYKDGEVGACIDISHKYGFEKGSKKVILESLVPYRMDVYYKEENHSYYLVGVKQSDIKFEKGRNVIDEEAYARILVNEKMIQPGQSRADLENLGFKFKLSFYKNDIIEYEKDGKIYTERLVSRTMPKQRNYIETKPIDKAKFEKQNLVGLGKTKFIKKYRYDILGNKYSCSEEKFTSFC

SEQ ID NO: 46 - protein, 1314 aa, Mycoplasma synoviae 53
MLRLYCANNLVLNNVQNLWKYLLLLIFDKKIIFLFKIKVILIRRYMENNNKEKIVIGFDLGVASVGWSIVNAETKEVIDLGVRLFSEPEKADYRRAKRTTRRLLRRKKFKREKFHKLILKNAEIFGLQSRNEILNVYKDQSSKYRNILKLKINALKEEIKPSELVWILRDYLQNRGYFYKNEKLTDEFVSNSFPSKKLHEHYEKYGFFRGSVKLDNKLDNKKDKAKEKDEEEESDAKKESEELIFSNKQWINEIVKVFENQSYLTESFKEEYLKLFNYVRPFNKGPGSKNSRTAYGVFSTDIDPETNKFKDYSNIWDKTIGKCSLFEEEIRAPKNLPSALIFNLQNEICTIKNEFTEFKNWWLNAEQKSEILKFVFTELFNWKDKKYSDKKFNKNLQDKIKKYLLNFALENFNLNEEILKNRDLENDTVLGLKGVKYYEKSNATADAALEFSSLKPLYVFIKFLKEKKLDLNYLLGLENTEILYFLDSIYLAISYSSDLKERNEWFKKLLKELYPKIKNNNLEIIENVEDIFEITDQEKFESFSKTHSLSREAFNHIIPLLLSNNEGKNYESLKHSNEELKKRTEKAELKAQQNQKYLKDNFLKEALVPLSVKTSVLQAIKIFNQIIKNFGKKYEISQVVIEMARELTKPNLEKLLNNATNSNIKILKEKLDQTEKFDDFTKKKFIDKIENSVVFRNKLFLWFEQDRKDPYTQLDIKINEIEDETEIDHVIPYSKSADDSWFNKLLVKKSTNQLKKNKTVWEYYQNESDPEAKWNKFVAWAKRIYLVQKSDKESKDNSEKNSIFKNKKPNLKFKNITKKLFDPYKDLGFLARNLNDTRYATKVFRDQLNNYSKHHSKDDENKLFKVVCMNGSITSFLRKSMWRKNEEQVYRFNFWKKDRDQFFHHAVDASIIAIFSLLTKTLYNKLRVYESYDVQRREDGVYLINKETGEVKKADKDYWKDQHNFLKIRENAIEIKNVLNNVDFQNQVRYSRKANTKLNTQLFNETLYGVKEFENNFYKLEKVNLFSRKDLRKFILEDLNEESEKNKKNENGSRKRILTEKYIVDEILQILENEEFKDSKSDINALNKYMDSLPSKFSEFFSQDFINKCKKENSLILTFDAIKHNDPKKVIKIKNLKFFREDATLKNKQAVHKDSKNQIKSFYESYKCVGFIWLKNKNDLEESIFVPINSRVIHFGDKDKDIFDFDSYNKEKLLNEINLKRPENKKFNSINEIEFVKFVKPGALLLNFENQQIYYISTLESSSLRAKIKLLNKMDKGKAVSMKKITNPDEYKIIEHVNPLGINLNWTKKLENNN

SEQ ID NO: 47 - protein, 1197 aa, Porphyromonas sp. oral taxon 279 str. F0450
MLMSKHVLGLDLGVGSIGWCLIALDAQGDPAEILGMGSRVVPLNNATKAIEAFNAGAAFTASQERTARRTMRRGFARYQLRRYRLRRELEKVGMLPDAALIQLPLLELWELRERAATAGRRLTLPELGRVLCHINQKRGYRHVKSDAAAIVGDEGEKKKDSNSAYLAGIRANDEKLQAEHKTVGQYFAEQLRQNQSESPTGGISYRIKDQIFSRQCYIDEYDQIMAVQRVHYPDILTDEFIRMLRDEVIFMQRPLKSCKHLVSLCEFEKQERVMRVQQDDGKGGWQLVERRVKFGPKVAPKSSPLFQLCCIYEAVNNIRLTRPNGSPCDITPEERAKIVAHLQSSASLSFAALKKLLKEKALIADQLTSKSGLKGNSTRVALASALQPYPQYHHLLDMELETRMMTVQLTDEETGEVTEREVAVVTDSYVRKPLYRLWHILYSIEEREAMRRALITQLGMKEEDLDGGLLDQLYRLDFVKPGYGNKSAKFICKLLPQLQQGLGYSEACAAVGYRHSNSPTSEEITERTLLEKIPLLQRNELRQPLVEKILNQMINLVNALKAEYGIDEVRVELARELKMSREERERMARNNKDREERNKGVAAKIRECGLYPTKPRIQKYMLWKEAGRQCLYCGRSIEEEQCLREGGMEVEHIIPKSVLYDDSYGNKTCACRRCNKEKGNRTALEYIRAKGREAEYMKRINDLLKEKKISYSKHQRLRWLKEDIPSDFLERQLRLTQYISRQAMAILQQGIRRVSASEGGVTARLRSLWGYGKILHTLNLDRYDSMGETERVSREGEATEELHITNWSKRMDHRHHAIDALVVACTRQSYIQRLNRLSSEFGREDKKKEDQEAQEQQATETGRLSNLERWLTQRPHFSVRTVSDKVAEILISYRPGQRVVTRGRNIYRKKMADGREVSCVQRGVLVPRGELMEASFYGKILSQGRVRIVKRYPLHDLKGEVVDPHLRELITTYNQELKSREKGAPIPPLCLDKDKKQEVRSVRCYAKTLSLDKAIPMCFDEKGEPTAFVKSASNHHLALYRTPKGKLVESIVTFWDAVDRARYGIPLVITHPREVMEQVLQRGDIPEQVLSLLPPSDWVFVDSLQQDEMVVIGLSDEELQRALEAQNYRKISEHLYRVQKMSSSYYVFRYHLETSVADDKNTSGRIPKFHRVQSLKAYEERNIRKVRVDLLGRISLL

SEQ ID NO: 48 - protein, 1121 aa, Streptococcus thermophilus LMD9
MSDLVLGLDIGIGSVGVGILNKVTGEIIHKNSRIFPAAQAENNLVRRTNRQGRRLARRKKHRRVRLNRLFEESGLITDFTKISINLNPYQLRVKGLTDELSNEELFIALKNMVKHRGISYLDDASDDGNSSVGDYAQIVKENSKQLETKTPGQIQLERYQTYGQLRGDFTVEKDGKKHRLINVFPTSAYRSEALRILQTQQEFNPQITDEFINRYLEILTGKRKYYHGPGNEKSRTDYGRYRTSGETLDNIFGILIGKCTFYPDEFRAAKASYTAQEFNLLNDLNNLTVPTETKKLSKEQKNQIINYVKNEKAMGPAKLFKYIAKLLSCDVADIKGYRIDKSGKAEIHTFEAYRKMKTLETLDIEQMDRETLDKLAYVLTLNTEREGIQEALEHEFADGSFSQKQVDELVQFRKANSSIFGKGWHNFSVKLMMELIPELYETSEEQMTILTRLGKQKTTSSSNKTKYIDEKLLTEEIYNPVVAKSVRQAIKIVNAAIKEYGDFDNIVIEMARETNEDDEKKAIQKIQKANKDEKDAAMLKAANQYNGKAELPHSVFHGHKQLATKIRLWHQQGERCLYTGKTISIHDLINNSNQFEVDHILPLSITFDDSLANKVLVYATANQEKGQRTPYQALDSMDDAWSFRELKAFVRESKTLSNKKKEYLLTEEDISKFDVRKKFIERNLVDTRYASRVVLNALQEHFRAHKIDTKVSVVRGQFTSQLRRHWGIEKTRDTYHHHAVDALIIAASSQLNLWKKQKNTLVSYSEDQLLDIETGELISDDEYKESVFKAPYQHFVDTLKSKEFEDSILFSYQVDSKFNRKISDATIYATRQAKVGKDKADETYVLGKIKDIYTQDGYDAFMKIYKKDKSKFLMYRHDPQTFEKVIEPILENYPNKQINEKGKEVPCNPFLKYKEEHGYIRKYSKKGNGPEIKSLKYYDSKLGNHIDITPKDSNNKVVLQSVSPWRADVYFNKTTGKYEILGLKYADLQFEKGTGTYKISQEKYNDIKKKEGVDSDSEFKFTLYKNDLLLVKDTETKEQQLFRFLSRTMPKQKHYVELKPYDKQKFEGGEALIKVLGNVANSGQCKKGLGKSNISIYKVRTDVLGNQHIIKNEGDKPKLDF

SEQ ID NO: 49 - protein, 1152 aa, Roseburia inulinivorans DSM 16841
MNAEHGKEGLLIMEENFQYRIGLDIGITSVGWAVLQNNSQDEPVRITDLGVRIFDVAENPKNGDALAAPRRDARTTRRRLRRRRHRLERIKFLLQENGLIEMDSFMERYYKGNLPDVYQLRYEGLDRKLKDEELAQVLIHIAKHRGFRSTRKAETKEKEGGAVLKATTENQKIMQEKGYRTVGEMLYLDEAFHTECLWNEKGYVLTPRNRPDDYKHTILRSMLVEEVHAIFAAQRAHGNQKATEGLEEAYVEIMTSQRSFDMGPGLQPDGKPSPYAMEGFGDRVGKCTFEKDEYRAPKATYTAELFVALQKINHTKLIDEFGTGRFFSEEERKTIIGLLLSSKELKYGTIRKKLNIDPSLKFNSLNYSAKKEGETEEERVLDTEKAKFASMFWTYEYSKCLKDRTEEMPVGEKADLFDRIGEILTAYKNDDSRSSRLKELGLSGEEIDGLLDLSPAKYQRVSLKAMRKMQPYLEDGLIYDKACEAAGYDFRALNDGNKKHLLKGEEINAIVNDITNPVVKRSVSQTIKVINAIIQKYGSPQAVNIELAREMSKNFQDRTNLEKEMKKRQQENERAKQQIIELGKQNPTGQDILKYRLWNDQGGYCLYSGKKIPLEELFDGGYDIDHILPYSITFDDSYRNKVLVTAQENRQKGNRTPYEYFGADEKRWEDYEASVRLLVRDYKKQQKLLKKNFTEEERKEFKERNLNDTKYITRVVYNMIRQNLELEPFNHPEKKKQVWAVNGAVTSYLRKRWGLMQKDRSTDRHHAMDAVVIACCTDGMIHKISRYMQGRELAYSRNFKFPDEETGEILNRDNFTREQWDEKFGVKVPLPWNSFRDELDIRLLNEDPKNFLLTHADVQRELDYPGWMYGEEESPIEEGRYINYIRPLFVSRMPNHKVTGSAHDATIRSARDYETRGVVITKVPLTDLKLNKDNEIEGYYDKDSDRLLYQALVRQLLLHGNDGKKAFAEDFHKPKADGTEGPVVRKVKIEKKQTSGVMVRGGTGIAANGEMVRIDVFRENGKYYFVPVYTADVVRKVLPNRAATHTKPYSEWRVMDDANFVFSLYSRDLIHVKSKKDIKTNLVNGGLLLQKEIFAYYTGADIATASIAGFANDSNFKFRGLGIQSLEIFEKCQVDILGNISVVRHENRQEFH

SEQ ID NO: 50 - protein, 1082 aa, Methylosinus trichosporium OB3b
MRVLGLDAGIASLGWALIEIEESNRGELSQGTIIGAGTWMFDAPEEKTQAGAKLKSEQRRTFRGQRRVVRRRRQRMNEVRRILHSHGLLPSSDRDALKQPGLDPWRIRAEALDRLLGPVELAVALGHIARHRGFKSNSKGAKTNDPADDTSKMKRAVNETREKLARFGSAAKMLVEDESFVLRQTPTKNGASEIVRRFRNREGDYSRSLLRDDLAAEMRALFTAQARFQSAIATADLQTAFTKAAFFQRPLQDSEKLVGPCPFEVDEKRAPKRGYSFELFRFLSRLNHVTLRDGKQERTLTRDELALAAADFGAAAKVSFTALRKKLKLPETTVFVGVKADEESKLDVVARSGKAAEGTARLRSVIVDALGELAWGALLCSPEKLDKIAEVISFRSDIGRISEGLAQAGCNAPLVDALTAAASDGRFDPFTGAGHISSKAARNILSGLRQGMTYDKACCAADYDHTASRERGAFDVGGHGREALKRILQEERISRELVGSPTARKALIESIKQVKAIVERYGVPDRIHVELARDVGKSIEEREEITRGIEKRNRQKDKLRGLFEKEVGRPPQDGARGKEELLRFELWSEQMGRCLYTDDYISPSQLVATDDAVQVDHILPWSRFADDSYANKTLCMAKANQDKKGRTPYEWFKAEKTDTEWDAFIVRVEALADMKGFKKRNYKLRNAEEAAAKFRNRNLNDTRWACRLLAEALKQLYPKGEKDKDGKERRRVFSRPGALTDRLRRAWGLQWMKKSTKGDRIPDDRHHALDAIVIAATTESLLQRATREVQEIEDKGLHYDLVKNVTPPWPGFREQAVEAVEKVFVARAERRRARGKAHDATIRHIAVREGEQRVYERRKVAELKLADLDRVKDAERNARLIEKLRNWIEAGSPKDDPPLSPKGDPIFKVRLVTKSKVNIALDTGNPKRPGTVDRGEMARVDVFRKASKKGKYEYYLVPIYPHDIATMKTPPIRAVQAYKPEDEWPEMDSSYEFCWSLVPMTYLQVISSKGEIFEGYYRGMNRSVGAIQLSAHSNSSDVVQGIGARTLTEFKKFNVDRFGRKHEVERELRTWRGETWRGKAYI

SEQ ID NO: 51 - protein, 1156 aa, Ruminococcus albus 8
MGNYYLGLDVGIGSIGWAVINIEKKRIEDFNVRIFKSGEIQEKNRNSRASQQCRRSRGLRRLYRRKSHRKLRLKNYLSIIGLTTSEKIDYYYETADNNVIQLRNKGLSEKLTPEEIAACLIHICNNRGYKDFYEVNVEDIEDPDERNEYKEEHDSIVLISNLMNEGGYCTPAEMICNCREFDEPNSVYRKFHNSAASKNHYLITRHMLVKEVDLILENQSKYYGILDDKTIAKIKDIIFAQRDFEIGPGKNERFRRFTGYLDSIGKCQFFKDQERGSRFTVIADIYAFVNVLSQYTYTNNRGESVFDTSFANDLINSALKNGSMDKRELKAIAKSYHIDISDKNSDTSLTKCFKYIKVVKPLFEKYGYDWDKLIENYTDTDNNVLNRIGIVLSQAQTPKRRREKLKALNIGLDDGLINELTKLKLSGTANVSYKYMQGSIEAFCEGDLYGKYQAKFNKEIPDIDENAKPQKLPPFKNEDDCEFFKNPVVFRSINETRKLINAIIDKYGYPAAVNIETADELNKTFEDRAIDTKRNNDNQKENDRIVKEIIECIKCDEVHARHLIEKYKLWEAQEGKCLYSGETITKEDMLRDKDKLFEVDHIVPYSLILDNTINNKALVYAEENQKKGQRTPLMYMNEAQAADYRVRVNTMFKSKKCSKKKYQYLMLPDLNDQELLGGWRSRNLNDTRYICKYLVNYLRKNLRFDRSYESSDEDDLKIRDHYRVFPVKSRFTSMFRRWWLNEKTWGRYDKAELKKLTYLDHAADAIIIANCRPEYVVLAGEKLKLNKMYHQAGKRITPEYEQSKKACIDNLYKLFRMDRRTAEKLLSGHGRLTPIIPNLSEEVDKRLWDKNIYEQFWKDDKDKKSCEELYRENVASLYKGDPKFASSLSMPVISLKPDHKYRGTITGEEAIRVKEIDGKLIKLKRKSISEITAESINSIYTDDKILIDSLKTIFEQADYKDVGDYLKKTNQHFFTTSSGKRVNKVTVIEKVPSRWLRKEIDDNNFSLLNDSSYYCIELYKDSKGDNNLQGIAMSDIVHDRKTKKLYLKPDFNYPDDYYTHVMYIFPGDYLRIKSTSKKSGEQLKFEGYFISVKNVNENSFRFISDNKPCAKDKRVSITKKDIVIKLAVDLMGKVQGENNGKGISCGEPLSLLKEKN

SEQ ID NO: 52 - protein, 1187 aa, Bifidobacterium longum DJO10A
MLSRQLLGASHLARPVSYSYNVQDNDVHCSYGERCFMRGKRYRIGIDVGLNSVGLAAVEVSDENSPVRLLNAQSVIHDGGVDPQKNKEAITRKNMSGVARRTRRMRRRKRERLHKLDMLLGKFGYPVIEPESLDKPFEEWHVRAELATRYIEDDELRRESISIALRHMARHRGWRNPYRQVDSLISDNPYSKQYGELKEKAKAYNDDATAAEEESTPAQLVVAMLDAGYAEAPRLRWRTGSKKPDAEGYLPVRLMQEDNANELKQIFRVQRVPADEWKPLFRSVFYAVSPKGSAEQRVGQDPLAPEQARALKASLAFQEYRIANVITNLRIKDASAELRKLTVDEKQSIYDQLVSPSSEDITWSDLCDFLGFKRSQLKGVGSLTEDGEERISSRPPRLTSVQRIYESDNKIRKPLVAWWKSASDNEHEAMIRLLSNTVDIDKVREDVAYASAIEFIDGLDDDALTKLDSVDLPSGRAAYSVETLQKLTRQMLTTDDDLHEARKTLFNVTDSWRPPADPIGEPLGNPSVDRVLKNVNRYLMNCQQRWGNPVSVNIEHVRSSFSSVAFARKDKREYEKNNEKRSIFRSSLSEQLRADEQMEKVRESDLRRLEAIQRQNGQCLYCGRTITFRTCEMDHIVPRKGVGSTNTRTNFAAVCAECNRMKSNTPFAIWARSEDAQTRGVSLAEAKKRVTMFTFNPKSYAPREVKAFKQAVIARLQQTEDDAAIDNRSIESVAWMADELHRRIDWYFNAKQYVNSASIDDAEAETMKTTVSVFQGRVTASARRAAGIEGKIHFIGQQSKTRLDRRHHAVDASVIAMMNTAAAQTLMERESLRESQRLIGLMPGERSWKEYPYEGTSRYESFHLWLDNMDVLLELLNDALDNDRIAVMQSQRYVLGNSIAHDATIHPLEKVPLGSAMSADLIRRASTPALWCALTRLPDYDEKEGLPEDSHREIRVHDTRYSADDEMGFFASQAAQIAVQEGSADIGSAIHHARVYRCWKTNAKGVRKYFYGMIRVFQTDLLRACHDDLFTVPLPPQSISMRYGEPRVVQALQSGNAQYLGSLVVGDEIEMDFSSLDVDGQIGEYLQFFSQFSGGNLAWKHWVVDGFFNQTQLRIRPRYLAAEGLAKAFSDDVVPDGVQKIVTKQGWLPPVNTASKTAVRIVRRNAFGEPRLSSAHHMPCSWQWRHE

SEQ ID NO: 53 - protein, 1150 aa, Enterococcus faecalis TX0012
MYSIGLDLGISSVGWSVIDERTGNVIDLGVRLFSAKNSEKNLERRTNRGGRRLIRRKTNRLKDAKKILAAVGFYEDKSLKNSCPYQLRVKGLTEPLSRGEIYKVTLHILKKRGISYLDEVDTEAAKESQDYKEQVRKNAQLLTKYTPGQIQLQRLKENNRVKTGINAQGNYQLNVFKVSAYANELATILKTQQAFYPNELTDDWIALFVQPGIAEEAGLIYRKRPYYHGPGNEANNSPYGRWSDFQKTGEPATNIFDKLIGKDFQGELRASGLSLSAQQYNLLNDLTNLKIDGEVPLSSEQKEYILTELMTKEFTRFGVNDVVKLLGVKKERLSGWRLDKKGKPEIHTLKGYRNWRKIFAEAGIDLATLPTETIDCLAKVLTLNTEREGIENTLAFELPELSESVKLLVLDRYKELSQSISTQSWHRFSLKTLHLLIPELMNATSEQNTLLEQFQLKSDVRKRYSEYKKLPTKDVLAEIYNPTVNKTVSQAFKVIDALLVKYGKEQIRYITIEMPRDDNEEDEKKRIKELHAKNSQRKNDSQSYFMQKSGWSQEKFQTTIQKNRRFLAKLLYYYEQDGICAYTGLPISPELLVSDSTEIDHIIPISISLDDSINNKVLVLSKANQVKGQQTPYDAWMDGSFKKINGKFSNWDDYQKWVESRHFSHKKENNLLETRNIFDSEQVEKFLARNLNDTRYASRLVLNTLQSFFTNQETKVRVVNGSFTHTLRKKWGADLDKTRETHHHHAVDATLCAVTSFVKVSRYHYAVKEETGEKVMREIDFETGEIVNEMSYWEFKKSKKYERKTYQVKWPNFREQLKPVNLHPRIKFSHQVDRKANRKLSDATIYSVREKTEVKTLKSGKQKITTDEYTIGKIKDIYTLDGWEAFKKKQDKLLMKDLDEKTYERLLSIAETTPDFQEVEEKNGKVKRVKRSPFAVYCEENDIPAIQKYAKKNNGPLIRSLKYYDGKLNKHINITKDSQGRPVEKTKNGRKVTLQSLKPYRYDIYQDLETKAYYTVQLYYSDLRFVEGKYGITEKEYMKKVAEQTKGQVVRFCFSLQKNDGLEIEWKDSQRYDVRFYNFQSANSINFKGLEQEMMPAENQFKQKPYNNGAINLNIAKYGKEGKKLRKFNTDILGKKHYLFYEKEPKNIIK

SEQ ID NO: 54 - protein, 1236 aa, Mycoplasma mobile 163K
MYFYKNKENKLNKKVVLGLDLGIASVGWCLTDISQKEDNKFPIILHGVRLFETVDDSDDKLLNETRRKKRGQRRRNRRLFTRKRDFIKYLIDNNIIELEFDKNPKILVRNFIEKYINPFSKNLELKYKSVTNLPIGFHNLRKAAINEKYKLDKSELIVLLYFYLSLRGAFFDNPEDTKSKEMNKNEIEIFDKNESIKNAEFPIDKIIEFYKISGKIRSTINLKFGHQDYLKEIKQVFEKQNIDFMNYEKFAMEEKSFFSRIRNYSEGPGNEKSFSKYGLYANENGNPELIINEKGQKIYTKIFKTLWESKIGKCSYDKKLYRAPKNSFSAKVFDITNKLTDWKHKNEYISERLKRKILLSRFLNKDSKSAVEKILKEENIKFENLSEIAYNKDDNKINLPIINAYHSLTTIFKKHLINFENYLISNENDLSKLMSFYKQQSEKLFVPNEKGSYEINQNNNVLHIFDAISNILNKFSTIQDRIRILEGYFEFSNLKKDVKSSEIYSEIAKLREFSGTSSLSFGAYYKFIPNLISEGSKNYSTISYEEKALQNQKNNFSHSNLFEKTWVEDLIASPTVKRSLRQTMNLLKEIFKYSEKNNLEIEKIVVEVTRSSNNKHERKKIEGINKYRKEKYEELKKVYDLPNENTTLLKKLWLLRQQQGYDAYSLRKIEANDVINKPWNYDIDHIVPRSISFDDSFSNLVIVNKLDNAKKSNDLSAKQFIEKIYGIEKLKEAKENWGNWYLRNANGKAFNDKGKFIKLYTIDNLDEFDNSDFINRNLSDTSYITNALVNHLTFSNSKYKYSVVSVNGKQTSNLRNQIAFVGIKNNKETEREWKRPEGFKSINSNDFLIREEGKNDVKDDVLIKDRSFNGHHAEDAYFITIISQYFRSFKRIERLNVNYRKETRELDDLEKNNIKFKEKASFDNFLLINALDELNEKLNQMRFSRMVITKKNTQLFNETLYSGKYDKGKNTIKKVEKLNLLDNRTDKIKKIEEFFDEDKLKENELTKLHIFNHDKNLYETLKIIWNEVKIEIKNKNLNEKNYFKYFVNKKLQEGKISFNEWVPILDNDFKIIRKIRYIKFSSEEKETDEIIFSQSNFLKIDQRQNFSFHNTLYWVQIWVYKNQKDQYCFISIDARNSKFEKDEIKINYEKLKTQKEKLQIINEEPILKINKGDLFENEEKELFYIVGRDEKPQKLEIKYILGKKIKDQKQIQKPVKKYFPNWKKVNLTYMGEIFKK

SEQ ID NO: 55 - protein, 1105 aa, Actinomyces coleocanis DSM 15436
MDNKNYRIGIDVGLNSIGFCAVEVDQHDTPLGFLNLSVYRHDAGIDPNGKKTNTTRLAMSGVARRTRRLFRKRKRRLAALDRFIEAQGWTLPDHADYKDPYTPWLVRAELAQTPIRDENDLHEKLAIAVRHIARHRGWRSPWVPVRSLHVEQPPSDQYLALKERVEAKTLLQMPEGATPAEMVVALDLSVDVNLRPKNREKTDTRPENKKPGFLGGKLMQSDNANELRKIAKIQGLDDALLRELIELVFAADSPKGASGELVGYDVLPGQHGKRRAEKAHPAFQRYRIASIVSNLRIRHLGSGADERLDVETQKRVFEYLLNAKPTADITWSDVAEEIGVERNLLMGTATQTADGERASAKPPVDVTNVAFATCKIKPLKEWWLNADYEARCVMVSALSHAEKLTEGTAAEVEVAEFLQNLSDEDNEKLDSFSLPIGRAAYSVDSLERLTKRMIENGEDLFEARVNEFGVSEDWRPPAEPIGARVGNPAVDRVLKAVNRYLMAAEAEWGAPLSVNIEHVREGFISKRQAVEIDRENQKRYQRNQAVRSQIADHINATSGVRGSDVTRYLAIQRQNGECLYCGTAITFVNSEMDHIVPRAGLGSTNTRDNLVATCERCNKSKSNKPFAVWAAECGIPGVSVAEALKRVDFWIADGFASSKEHRELQKGVKDRLKRKVSDPEIDNRSMESVAWMARELAHRVQYYFDEKHTGTKVRVFRGSLTSAARKASGFESRVNFIGGNGKTRLDRRHHAMDAATVAMLRNSVAKTLVLRGNIRASERAIGAAETWKSFRGENVADRQIFESWSENMRVLVEKFNLALYNDEVSIFSSLRLQLGNGKAHDDTITKLQMHKVGDAWSLTEIDRASTPALWCALTRQPDFTWKDGLPANEDRTIIVNGTHYGPLDKVGIFGKAAASLLVRGGSVDIGSAIHHARIYRIAGKKPTYGMVRVFAPDLLRYRNEDLFNVELPPQSVSMRYAEPKVREAIREGKAEYLGWLVVGDELLLDLSSETSGQIAELQQDFPGTTHWTVAGFFSPSRLRLRPVYLAQEGLGEDVSEGSKSIIAGQGWRPAVNKVFGSAMPEVIRRDGLGRKRRFSYSGLPVSWQG

SEQ ID NO: 56 - protein, 1079 aa, Dinoroseobacter shibae DFL 12
MRLGLDIGTSSIGWWLYETDGAGSDARITGVVDGGVRIFSDGRDPKSGASLAVDRRAARAMRRRRDRYLRRRATLMKVLAETGLMPADPAEAKALEALDPFALRAAGLDEPLPLPHLGRALFHLNQRRGFKSNRKTDRGDNESGKIKDATARLDMEMMANGARTYGEFLHKRRQKATDPRHVPSVRTRLSIANRGGPDGKEEAGYDFYPDRRHLEEEFHKLWAAQGAHHPELTETLRDLLFEKIFFQRPLKEPEVGLCLFSGHHGVPPKDPRLPKAHPLTQRRVLYETVNQLRVTADGREARPLTREERDQVIHALDNKKPTKSLSSMVLKLPALAKVLKLRDGERFTLETGVRDAIACDPLRASPAHPDRFGPRWSILDADAQWEVISRIRRVQSDAEHAALVDWLTEAHGLDRAHAEATAHAPLPDGYGRLGLTATTRILYQLTADVVTYADAVKACGWHHSDGRTGECFDRLPYYGEVLERHVIPGSYHPDDDDITRFGRITNPTVHIGLNQLRRLVNRIIETHGKPHQIVVELARDLKKSEEQKRADIKRIRDTTEAAKKRSEKLEELEIEDNGRNRMLLRLWEDLNPDDAMRRFCPYTGTRISAAMIFDGSCDVDHILPYSRTLDDSFPNRTLCLREANRQKRNQTPWQAWGDTPHWHAIAANLKNLPENKRWRFAPDAMTRFEGENGFLDRALKDTQYLARISRSYLDTLFTKGGHVWVVPGRFTEMLRRHWGLNSLLSDAGRGAVKAKNRTDHRHHAIDAAVIAATDPGLLNRISRAAGQGEAAGQSAELIARDTPPPWEGFRDDLRVRLDRIIVSHRADHGRIDHAARKQGRDSTAGQLHQETAYSIVDDIHVASRTDLLSLKPAQLLDEPGRSGQVRDPQLRKALRVATGGKTGKDFENALRYFASKPGPYQAIRRVRIIKPLQAQARVPVPAQDPIKAYQGGSNHLFEIWRLPDGEIEAQVITSFEAHTLEGEKRPHPAAKRLLRVHKGDMVALERDGRRVVGHVQKMDIANGLFIVPHNEANADTRNNDKSDPFKWIQIGARPAIASGIRRVSVDEIGRLRDGGTRPI

SEQ ID NO: 57 - protein, 1181 aa, Actinomyces sp. oral taxon 180 str. F0310
MLHCIAVIRVPPSEEPGFFETHADSCALCHHGCMTYAANDKAIRYRVGIDVGLRSIGFCAVEVDDEDHPIRILNSVVHVHDAGTGGPGETESLRKRSGVAARARRRGRAEKQRLKKLDVLLEELGWGVSSNELLDSHAPWHIRKRLVSEYIEDETERRQCLSVAMAHIARHRGWRNSFSKVDTLLLEQAPSDRMQGLKERVEDRTGLQFSEEVTQGELVATLLEHDGDVTIRGFVRKGGKATKVHGVLEGKYMQSDLVAELRQICRTQRVSETTFEKLVLSIFHSKEPAPSAARQRERVGLDELQLALDPAAKQPRAERAHPAFQKFKVVATLANMRIREQSAGERSLTSEELNRVARYLLNHTESESPTWDDVARKLEVPRHRLRGSSRASLETGGGLTYPPVDDTTVRVMSAEVDWLADWWDCANDESRGHMIDAISNGCGSEPDDVEDEEVNELISSATAEDMLKLELLAKKLPSGRVAYSLKTLREVTAAILETGDDLSQAITRLYGVDPGWVPTPAPIEAPVGNPSVDRVLKQVARWLKFASKRWGVPQTVNIEHTREGLKSASLLEEERERWERFEARREIRQKEMYKRLGISGPFRRSDQVRYEILDLQDCACLYCGNEINFQTFEVDHIIPRVDASSDSRRTNLAAVCHSCNSAKGGLAFGQWVKRGDCPSGVSLENAIKRVRSWSKDRLGLTEKAMGKRKSEVISRLKTEMPYEEFDGRSMESVAWMAIELKKRIEGYFNSDRPEGCAAVQVNAYSGRLTACARRAAHVDKRVRLIRLKGDDGHHKNRFDRRNHAMDALVIALMTPAIARTIAVREDRREAQQLTRAFESWKNFLGSEERMQDRWESWIGDVEYACDRLNELIDADKIPVTENLRLRNSGKLHADQPESLKKARRGSKRPRPQRYVLGDALPADVINRVTDPGLWTALVRAPGFDSQLGLPADLNRGLKLRGKRISADFPIDYFPTDSPALAVQGGYVGLEFHHARLYRIIGPKEKVKYALLRVCAIDLCGIDCDDLFEVELKPSSISMRTADAKLKEAMGNGSAKQIGWLVLGDEIQIDPTKFPKQSIGKFLKECGPVSSWRVSALDTPSKITLKPRLLSNEPLLKTSRVGGHESDLVVAECVEKIMKKTGWVVEINALCQSGLIRVIRRNALGEVRTSPKSGLPISLNLR

SEQ ID NO: 58 - protein, 1113 aa, Alcanivorax sp. W115
MRYRVGLDLGTASVGAAVFSMDEQGNPMELIWHYERLFSEPLVPDMGQLKPKKAARRLARQQRRQIDRRASRLRRIAIVSRRLGIAPGRNDSGVHGNDVPTLRAMAVNERIELGQLRAVLLRMGKKRGYGGTFKAVRKVGEAGEVASGASRLEEEMVALASVQNKDSVTVGEYLAARVEHGLPSKLKVAANNEYYAPEYALFRQYLGLPAIKGRPDCLPNMYALRHQIEHEFERIWATQSQFHDVMKDHGVKEEIRNAIFFQRPLKSPADKVGRCSLQTNLPRAPRAQIAAQNFRIEKQMADLRWGMGRRAEMLNDHQKAVIRELLNQQKELSFRKIYKELERAGCPGPEGKGLNMDRAALGGRDDLSGNTTLAAWRKLGLEDRWQELDEVTQIQVINFLADLGSPEQLDTDDWSCRFMGKNGRPRNFSDEFVAFMNELRMTDGFDRLSKMGFEGGRSSYSIKALKALTEWMIAPHWRETPETHRVDEEAAIRECYPESLATPAQGGRQSKLEPPPLTGNEVVDVALRQVRHTINMMIDDLGSVPAQIVVEMAREMKGGVTRRNDIEKQNKRFASERKKAAQSIEENGKTPTPARILRYQLWIEQGHQCPYCESNISLEQALSGAYTNFEHILPRTLTQIGRKRSELVLAHRECNDEKGNRTPYQAFGHDDRRWRIVEQRANALPKKSSRKTRLLLLKDFEGEALTDESIDEFADRQLHESSWLAKVTTQWLSSLGSDVYVSRGSLTAELRRRWGLDTVIPQVRFESGMPVVDEEGAEITPEEFEKFRLQWEGHRVTREMRTDRRPDKRIDHRHHLVDAIVTALTSRSLYQQYAKAWKVADEKQRHGRVDVKVELPMPILTIRDIALEAVRSVRISHKPDRYPDGRFFEATAYGIAQRLDERSGEKVDWLVSRKSLTDLAPEKKSIDVDKVRANISRIVGEAIRLHISNIFEKRVSKGMTPQQALREPIEFQGNILRKVRCFYSKADDCVRIEHSSRRGHHYKMLLNDGFAYMEVPCKEGILYGVPNLVRPSEAVGIKRAPESGDFIRFYKGDTVKNIKTGRVYTIKQILGDGGGKLILTPVTETKPADLLSAKWGRLKVGGRNIHLLRLCAE

SEQ ID NO: 59 - protein, 1052 aa, Aminomonas paucivorans DSM 12260
MIGEHVRGGCLFDDHWTPNWGAFRLPNTVRTFTKAENPKDGSSLAEPRRQARGLRRRLRRKTQRLEDLRRLLAKEGVLSLSDLETLFRETPAKDPYQLRAEGLDRPLSFPEWVRVLYHITKHRGFQSNRRNPVEDGQERSRQEEEGKLLSGVGENERLLREGGYRTAGEMLARDPKFQDHRRNRAGDYSHTLSRSLLLEEARRLFQSQRTLGNPHASSNLEEAFLHLVAFQNPFASGEDIRNKAGHCSLEPDQIRAPRRSASAETFMLLQKTGNLRLIHRRTGEERPLTDKEREQIHLLAWKQEKVTHKTLRRHLEIPEEWLFTGLPYHRSGDKAEEKLFVHLAGIHEIRKALDKGPDPAVWDTLRSRRDLLDSIADTLTFYKNEDEILPRLESLGLSPENARALAPLSFSGTAHLSLSALGKLLPHLEEGKSYTQARADAGYAAPPPDRHPKLPPLEEADWRNPVVFRALTQTRKVVNALVRRYGPPWCIHLETARELSQPAKVRRRIETEQQANEKKKQQAEREFLDIVGTAPGPGDLLKMRLWREQGGFCPYCEEYLNPTRLAEPGYAEMDHILPYSRSLDNGWHNRVLVHGKDNRDKGNRTPFEAFGGDTARWDRLVAWVQASHLSAPKKRNLLREDFGEEAERELKDRNLTDTRFITKTAATLLRDRLTFHPEAPKDPVMTLNGRLTAFLRKQWGLHKNRKNGDLHHALDAAVLAVASRSFVYRLSSHNAAWGELPRGREAENGFSLPYPAFRSEVLARLCPTREEILLRLDQGGVGYDEAFRNGLRPVFVSRAPSRRLRGKAHMETLRSPKWKDHPEGPRTASRIPLKDLNLEKLERMVGKDRDRKLYEALRERLAAFGGNGKKAFVAPFRKPCRSGEGPLVRSLRIFDSGYSGVELRDGGEVYAVADHESMVRVDVYAKKNRFYLVPVYVADVARGIVKNRAIVAHKSEEEWDLVDGSFDFRFSLFPGDLVEIEKKDGAYLGYYKSCHRGDGRLLLDRHDRMPRESDCGTFYVSTRKDVLSMSKYQVDPLGEIRLVGSEKPPFVL

SEQ ID NO: 60 - protein, 1233 aa, Mycoplasma canis PG 14
MEKKRKVTLGFDLGIASVGWAIVDSETNQVYKLGSRLFDAPDTNLERRTQRGTRRLLRRRKYRNQKFYNLVKRTEVFGLSSREAIENRFRELSIKYPNIIELKTKALSQEVCPDEIAWILHDYLKNRGYFYDEKETKEDFDQQTVESMPSYKLNEFYKKYGYFKGALSQPTESEMKDNKDLKEAFFFDFSNKEWLKEINYFFNVQKNILSETFIEEFKKIFSFTRDISKGPGSDNMPSPYGIFGEFGDNGQGGRYEHIWDKNIGKCSIFTNEQRAPKYLPSALIFNFLNELANIRLYSTDKKNIQPLWKLSSVDKLNILLNLFNLPISEKKKKLTSTNINDIVKKESIKSIMISVEDIDMIKDEWAGKEPNVYGVGLSGLNIEESAKENKFKFQDLKILNVLINLLDNVGIKFEFKDRNDIIKNLELLDNLYLFLIYQKESNNKDSSIDLFIAKNESLNIENLKLKLKEFLLGAGNEFENHNSKTHSLSKKAIDEILPKLLDNNEGWNLEAIKNYDEEIKSQIEDNSSLMAKQDKKYLNDNFLKDAILPPNVKVTFQQAILIFNKIIQKFSKDFEIDKVVIELAREMTQDQENDALKGIAKAQKSKKSLVEERLEANNIDKSVFNDKYEKLIYKIFLWISQDFKDPYTGAQISVNEIVNNKVEIDHIIPYSLCFDDSSANKVLVHKQSNQEKSNSLPYEYIKQGHSGWNWDEFTKYVKRVFVNNVDSILSKKERLKKSENLLTASYDGYDKLGFLARNLNDTRYATILFRDQLNNYAEHHLIDNKKMFKVIAMNGAVTSFIRKNMSYDNKLRLKDRSDFSHHAYDAAIIALFSNKTKTLYNLIDPSLNGIISKRSEGYWVIEDRYTGEIKELKKEDWTSIKNNVQARKIAKEIEEYLIDLDDEVFFSRKTKRKTNRQLYNETIYGIATKTDEDGITNYYKKEKFSILDDKDIYLRLLREREKFVINQSNPEVIDQIIEIIESYGKENNIPSRDEAINIKYTKNKINYNLYLKQYMRSLTKSLDQFSEEFINQMIANKTFVLYNPTKNTTRKIKFLRLVNDVKINDIRKNQVINKFNGKNNEPKAFYENINSLGAIVFKNSANNFKTLSINTQIAIFGDKNWDIEDFKTYNMEKIEKYKEIYGIDKTYNFHSFIFPGTILLDKQNKEFYYISSIQTVRDIIEIKFLNKIEFKDENKNQDTSKTPKRLMFGIKSIMNNYEQVDISPFGINKKIFE

SEQ ID NO: 61 - protein, 1119 aa, Lactobacillus coryniformis KCTC 3535
MGYRIGLDVGITSTGYAVLKTDKNGLPYKILTLDSVIYPRAENPQTGASLAEPRRIKRGLRRRTRRTKFRKQRTQQLFIHSGLLSKPEIEQILATPQAKYSVYELRVAGLDRRLTNSELFRVLYFFIGHRGFKSNRKAELNPENEADKKQMGQLLNSIEEIRKAIAEKGYRTVGELYLKDPKYNDHKRNKGYIDGYLSTPNRQMLVDEIKQILDKQRELGNEKLTDEFYATYLLGDENRAGIFQAQRDFDEGPGAGPYAGDQIKKMVGKDIFEPTEDRAAKATYTFQYFNLLQKMTSLNYQNTTGDTWHTLNGLDRQAIIDAVFAKAEKPTKTYKPTDFGELRKLLKLPDDARFNLVNYGSLQTQKEIETVEKKTRFVDFKAYHDLVKVLPEEMWQSRQLLDHIGTALTLYSSDKRRRRYFAEELNLPAELIEKLLPLNFSKFGHLSIKSMQNIIPYLEMGQVYSEATTNTGYDFRKKQISKDTIREEITNPVVRRAVTKTIKIVEQIIRRYGKPDGINIELARELGRNFKERGDIQKRQDKNRQTNDKIAAELTELGIPVNGQNIIRYKLHKEQNGVDPYTGDQIPFERAFSEGYEVDHIIPYSISWDDSYTNKVLTSAKCNREKGNRIPMVYLANNEQRLNALTNIADNIIRNSRKRQKLLKQKLSDEELKDWKQRNINDTRFITRVLYNYFRQAIEFNPELEKKQRVLPLNGEVTSKIRSRWGFLKVREDGDLHHAIDATVIAAITPKFIQQVTKYSQHQEVKNNQALWHDAEIKDAEYAAEAQRMDADLFNKIFNGFPLPWPEFLDELLARISDNPVEMMKSRSWNTYTPIEIAKLKPVFVVRLANHKISGPAHLDTIRSAKLFDEKGIVLSRVSITKLKINKKGQVATGDGIYDPENSNNGDKVVYSAIRQALEAHNGSGELAFPDGYLEYVDHGTKKLVRKVRVAKKVSLPVRLKNKAAADNGSMVRIDVFNTGKKFVFVPIYIKDTVEQVLPNKAIARGKSLWYQITESDQFCFSLYPGDMVHIESKTGIKPKYSNKENNTSVVPIKNFYGYFDGADIATASILVRAHDSSYTARSIGIAGLLKFEKYQVDYFGRYHKVHEKKRQLFVKRDE

SEQ ID NO: 62 - protein, 1195 aa, Elusimicrobium minutum Pei191
MQKNINTKQNHIYIKQAQKIKEKLGDKPYRIGLDLGVGSIGFAIVSMEENDGNVLLPKEIIMVGSRIFKASAGAADRKLSRGQRNNHRHTRERMRYLWKVLAEQKLALPVPADLDRKENSSEGETSAKRFLGDVLQKDIYELRVKSLDERLSLQELGYVLYHIAGHRGSSAIRTFENDSEEAQKENTENKKIAGNIKRLMAKKNYRTYGEYLYKEFFENKEKHKREKISNAANNHKFSPTRDLVIKEAEAILKKQAGKDGFHKELTEEYIEKLTKAIGYESEKLIPESGFCPYLKDEKRLPASHKLNEERRLWETLNNARYSDPIVDIVTGEITGYYEKQFTKEQKQKLFDYLLTGSELTPAQTKKLLGLKNTNFEDIILQGRDKKAQKIKGYKLIKLESMPFWARLSEAQQDSFLYDWNSCPDEKLLTEKLSNEYHLTEEEIDNAFNEIVLSSSYAPLGKSAMLIILEKIKNDLSYTEAVEEALKEGKLTKEKQAIKDRLPYYGAVLQESTQKIIAKGFSPQFKDKGYKTPHTNKYELEYGRIANPVVHQTLNELRKLVNEIIDILGKKPCEIGLETARELKKSAEDRSKLSREQNDNESNRNRIYEIYIRPQQQVIITRRENPRNYILKFELLEEQKSQCPFCGGQISPNDIINNQADIEHLFPIAESEDNGRNNLVISHSACNADKAKRSPWAAFASAAKDSKYDYNRILSNVKENIPHKAWRFNQGAFEKFIENKPMAARFKTDNSYISKVAHKYLACLFEKPNIICVKGSLTAQLRMAWGLQGLMIPFAKQLITEKESESFNKDVNSNKKIRLDNRHHALDAIVIAYASRGYGNLLNKMAGKDYKINYSERNWLSKILLPPNNIVWENIDADLESFESSVKTALKNAFISVKHDHSDNGELVKGTMYKIFYSERGYTLTTYKKLSALKLTDPQKKKTPKDFLETALLKFKGRESEMKNEKIKSAIENNKRLFDVIQDNLEKAKKLLEEENEKSKAEGKKEKNINDASIYQKAISLSGDKYVQLSKKEPGKFFAISKPTPTTTGYGYDTGDSLCVDLYYDNKGKLCGEIIRKIDAQQKNPLKYKEQGFTLFERIYGGDILEVDFDIHSDKNSFRNNTGSAPENRVFIKVGTFTEITNNNIQIWFGNIIKSTGGQDDSFTINSMQQYNPRKLILSSCGFIKYRSPILKNKEG

SEQ ID NO: 63 - protein, 1082 aa, Neisseria meningitidis Z2491
MAAFKPNPINYILGLDIGIASVGWAMVEIDEDENPICLIDLGVRVFERAEVPKTGDSLAMARRLARSVRRLTRRRAHRLLRARRLLKREGVLQAADFDENGLIKSLPNTPWQLRAAALDRKLTPLEWSAVLLHLIKHRGYLSQRKNEGETADKELGALLKGVADNAHALQTGDFRTPAELALNKFEKESGHIRNQRGDYSHTFSRKDLQAELILLFEKQKEFGNPHVSGGLKEGIETLLMTQRPALSGDAVQKMLGHCTFEPAEPKAAKNTYTAERFIWLTKLNNLRILEQGSERPLTDTERATLMDEPYRKSKLTYAQARKLLGLEDTAFFKGLRYGKDNAEASTLMEMKAYHAISRALEKEGLKDKKSPLNLSPELQDEIGTAFSLFKTDEDITGRLKDRIQPEILEALLKHISFDKFVQISLKALRRIVPLMEQGKRYDEACAEIYGDHYGKKNTEEKIYLPPIPADEIRNPVVLRALSQARKVINGVVRRYGSPARIHIETAREVGKSFKDRKEIEKRQEENRKDREKAAAKFREYFPNFVGEPKSKDILKLRLYEQQHGKCLYSGKEINLGRLNEKGYVEIDHALPFSRTWDDSFNNKVLVLGSENQNKGNQTPYEYFNGKDNSREWQEFKARVETSRFPRSKKQRILLQKFDEDGFKERNLNDTRYVNRFLCQFVADRMRLTGKGKKRVFASNGQITNLLRGFWGLRKVRAENDRHHALDAVVVACSTVAMQQKITRFVRYKEMNAFDGKTIDKETGEVLHQKTHFPQPWEFFAQEVMIRVFGKPDGKPEFEEADTPEKLRTLLAEKLSSRPEAVHEYVTPLFVSRAPNRKMSGQGHMETVKSAKRLDEGVSVLRVPLTQLKLKDLEKMVNREREPKLYEALKARLEAHKDDPAKAFAEPFYKYDKAGNRTQQVKAVRVEQVQKTGVWVRNHNGIADNATMVRVDVFEKGDKYYLVPIYSWQVAKGILPDRAVVQGKDEEDWQLIDDSFNFKFSLHPNDLVEVITKKARMFGYFASCHRGTGNINIRIHDLDHKIGKNGILEGIGVKTALSFQKYQIDELGKEIRPCRLKKRPPVR

SEQ ID NO: 64 - protein, 1056 aa, Pasteurella multocida str. Pm70
MQTTNLSYILGLDLGIASVGWAVVEINENEDPIGLIDVGVRIFERAEVPKTGESLALSRRLARSTRRLIRRRAHRLLLAKRFLKREGILSTIDLEKGLPNQAWELRVAGLERRLSAIEWGAVLLHLIKHRGYLSKRKNESQTNNKELGALLSGVAQNHQLLQSDDYRTPAELALKKFAKEEGHIRNQRGAYTHTFNRLDLLAELNLLFAQQHQFGNPHCKEHIQQYMTELLMWQKPALSGEAILKMLGKCTHEKNEFKAAKHTYSAERFVWLTKLNNLRILEDGAERALNEEERQLLINHPYEKSKLTYAQVRKLLGLSEQAIFKHLRYSKENAESATFMELKAWHAIRKALENQGLKDTWQDLAKKPDLLDEIGTAFSLYKTDEDIQQYLTNKVPNSVINALLVSLNFDKFIELSLKSLRKILPLMEQGKRYDQACREIYGHHYGEANQKTSQLLPAIPAQEIRNPVVLRTLSQARKVINAIIRQYGSPARVHIETGRELGKSFKERREIQKQQEDNRTKRESAVQKFKELFSDFSSEPKSKDILKFRLYEQQHGKCLYSGKEINIHRLNEKGYVEIDHALPFSRTWDDSFNNKVLVLASENQNKGNQTPYEWLQGKINSERWKNFVALVLGSQCSAAKKQRLLTQVIDDNKFIDRNLNDTRYIARFLSNYIQENLLLVGKNKKNVFTPNGQITALLRSRWGLIKARENNNRHHALDAIVVACATPSMQQKITRFIRFKEVHPYKIENRYEMVDQESGEIISPHFPEPWAYFRQEVNIRVFDNHPDTVLKEMLPDRPQANHQFVQPLFVSRAPTRKMSGQGHMETIKSAKRLAEGISVLRIPLTQLKPNLLENMVNKEREPALYAGLKARLAEFNQDPAKAFATPFYKQGGQQVKAIRVEQVQKSGVLVRENNGVADNASIVRTDVFIKNNKFFLVPIYTWQVAKGILPNKAIVAHKNEDEWEEMDEGAKFKFSLFPNDLVELKTKKEYFFGYYIGLDRATGNISLKEHDGEISKGKDGVYRVGVKLALSFEKYQVDELGKNRQICRPQQRQPVR

SEQ ID NO: 65 - protein, 1059 aa, Rhodovulum sp. PH10
MGIRFAFDLGTNSIGWAVWRTGPGVFGEDTAASLDGSGVLIFKDGRNPKDGQSLATMRRVPRQSRKRRDRFVLRRRDLLAALRKAGLFPVDVEEGRRLAATDPYHLRAKALDESLTPHEMGRVIFHLNQRRGFRSNRKADRQDREKGKIAEGSKRLAETLAATNCRTLGEFLWSRHRGTPRTRSPTRIRMEGEGAKALYAFYPTREMVRAEFERLWTAQSRFAPDLLTPERHEEIAGILFRQRDLAPPKIGCCTFEPSERRLPRALPSVEARGIYERLAHLRITTGPVSDRGLTRPERDVLASALLAGKSLTFKAVRKTLKILPHALVNFEEAGEKGLDGALTAKLLSKPDHYGAAWHGLSFAEKDTFVGKLLDEADEERLIRRLVTENRLSEDAARRCASIPLADGYGRLGRTANTEILAALVEETDETGTVVTYAEAVRRAGERTGRNWHHSDERDGVILDRLPYYGEILQRHVVPGSGEPEEKNEAARWGRLANPTVHIGLNQLRKVVNRLIAAHGRPDQIVVELARELKLNREQKERLDRENRKNREENERRTAILAEHGQRDTAENKIRLRLFEEQARANAGIALCPYTGRAIGIAELFTSEVEIDHILPVSLTLDDSLANRVLCRREANREKRRQTPFQAFGATPAWNDIVARAAKLPPNKRWRFDPAALERFEREGGFLGRQLNETKYLSRLAKIYLGKICDPDRVYVTPGTLTGLLRARWGLNSILSDSNFKNRSDHRHHAVDAVVIGVLTRGMIQRIAHDAARAEDQDLDRVFRDVPVPFEDFRDHVRERVSTITVAVKPEHGKGGALHEDTSYGLVPDTDPNAALGNLVVRKPIRSLTAGEVDRVRDRALRARLGALAAPFRDESGRVRDAKGLAQALEAFGAENGIRRVRILKPDASVVTIADRRTGVPYRAVAPGENHHVDIVQMRDGSWRGFAASVFEVNRPGWRPEWEVKKLGGKLVMRLHKGDMVELSDKDGQRRVKVVQQIEISANRVRLSPHNDGGKLQDRHADADDPFRWDLATIPLLKDRGCVAVRVDPIGVVTLRRSNV

SEQ ID NO: 66 - protein, 1096 aa, Eubacterium dolichum DSM 3991
MMEVFMGRLVLGLDIGITSVGFGIIDLDESEIVDYGVRLFKEGTAAENETRRTKRGGRRLKRRRVTRREDMLHLLKQAGIISTSFHPLNNPYDVRVKGLNERLNGEELATALLHLCKHRGSSVETIEDDEAKAKEAGETKKVLSMNDQLLKSGKYVCEIQKERLRTNGHIRGHENNFKTRAYVDEAFQILSHQDLSNELKSAIITIISRKRMYYDGPGGPLSPTPYGRYTYFGQKEPIDLIEKMRGKCSLFPNEPRAPKLAYSAELFNLLNDLNNLSIEGEKLTSEQKAMILKIVHEKGKITPKQLAKEVGVSLEQIRGFRIDTKGSPLLSELTGYKMIREVLEKSNDEHLEDHVFYDEIAEILTKTKDIEGRKKQISELSSDLNEESVHQLAGLTKFTAYHSLSFKALRLINEEMLKTELNQMQSITLFGLKQNNELSVKGMKNIQADDTAILSPVAKRAQRETFKVVNRLREIYGEFDSIVVEMAREKNSEEQRKAIRERQKFFEMRNKQVADIIGDDRKINAKLREKLVLYQEQDGKTAYSLEPIDLKLLIDDPNAYEVDHIIPISISLDDSITNKVLVTHRENQEKGNLTPISAFVKGRFTKGSLAQYKAYCLKLKEKNIKTNKGYRKKVEQYLLNENDIYKYDIQKEFINRNLVDTSYASRVVLNTLTTYFKQNEIPTKVFTVKGSLTNAFRRKINLKKDRDEDYGHHAIDALIIASMPKMRLLSTIFSRYKIEDIYDESTGEVFSSGDDSMYYDDRYFAFIASLKAIKVRKFSHKIDTKPNRSVADETIYSTRVIDGKEKVVKKYKDIYDPKFTALAEDILNNAYQEKYLMALHDPQTFDQIVKVVNYYFEEMSKSEKYFTKDKKGRIKISGMNPLSLYRDEHGMLKKYSKKGDGPAITQMKYFDGVLGNHIDISAHYQVRDKKVVLQQISPYRTDFYYSKENGYKFVTIRYKDVRWSEKKKKYVIDQQDYAMKKAEKKIDDTYEFQFSMHRDELIGITKAEGEALIYPDETWHNFNFFFHAGETPEILKFTATNNDKSNKIEVKPIHCYCKMRLMPTISKKIVRIDKYATDVVGNLYKVKKNTLKFEFD

SEQ ID NO: 67 - protein, 1132 aa, Nitratifractor salsuginis DSM 16511
MKKILGVDLGITSFGYAILQETGKDLYRCLDNSVVMRNNPYDEKSGESSQSIRSTQKSMRRLIEKRKKRIRCVAQTMERYGILDYSETMKINDPKNNPIKNRWQLRAVDAWKRPLSPQELFAIFAHMAKHRGYKSIATEDLIYELELELGLNDPEKESEKKADERRQVYNALRHLEELRKKYGGETIAQTIHRAVEAGDLRSYRNHDDYEKMIRREDIEEEIEKVLLRQAELGALGLPEEQVSELIDELKACITDQEMPTIDESLFGKCTFYKDELAAPAYSYLYDLYRLYKKLADLNIDGYEVTQEDREKVIEWVEKKIAQGKNLKKITHKDLRKILGLAPEQKIFGVEDERIVKGKKEPRTFVPFFFLADIAKFKELFASIQKHPDALQIFRELAEILQRSKTPQEALDRLRALMAGKGIDTDDRELLELFKNKRSGTRELSHRYILEALPLFLEGYDEKEVQRILGFDDREDYSRYPKSLRHLHLREGNLFEKEENPINNHAVKSLASWALGLIADLSWRYGPFDEIILETTRDALPEKIRKEIDKAMREREKALDKIIGKYKKEFPSIDKRLARKIQLWERQKGLDLYSGKVINLSQLLDGSADIEHIVPQSLGGLSTDYNTIVTLKSVNAAKGNRLPGDWLAGNPDYRERIGMLSEKGLIDWKKRKNLLAQSLDEIYTENTHSKGIRATSYLEALVAQVLKRYYPFPDPELRKNGIGVRMIPGKVTSKTRSLLGIKSKSRETNFHHAEDALILSTLTRGWQNRLHRMLRDNYGKSEAELKELWKKYMPHIEGLTLADYIDEAFRRFMSKGEESLFYRDMFDTIRSISYWVDKKPLSASSHKETVYSSRHEVPTLRKNILEAFDSLNVIKDRHKLTTEEFMKRYDKEIRQKLWLHRIGNTNDESYRAVEERATQIAQILTRYQLMDAQNDKEIDEKFQQALKELITSPIEVTGKLLRKMRFVYDKLNAMQIDRGLVETDKNMLGIHISKGPNEKLIFRRMDVNNAHELQKERSGILCYLNEMLFIFNKKGLIHYGCLRSYLEKGQGSKYIALFNPRFPANPKAQPSKFTSDSKIKQVGIGSATGIIKAHLDLDGHVRSYEVFGTLPEGSIEWFKEESGYGRVEDDPHH

SEQ ID NO: 68 - protein, 1173 aa, Rhodospirillum rubrum ATCC 11170
MRPIEPWILGLDIGTDSLGWAVFSCEEKGPPTAKELLGGGVRLFDSGRDAKDHTSRQAERGAFRRARRQTRTWPWRRDRLIALFQAAGLTPPAAETRQIALALRREAVSRPLAPDALWAALLHLAHHRGFRSNRIDKRERAAAKALAKAKPAKATAKATAPAKEADDEAGFWEGAEAALRQRMAASGAPTVGALLADDLDRGQPVRMRYNQSDRDGVVAPTRALIAEELAEIVARQSSAYPGLDWPAVTRLVLDQRPLRSKGAGPCAFLPGEDRALRALPTVQDFIIRQTLANLRLPSTSADEPRPLTDEEHAKALALLSTARFVEWPALRRALGLKRGVKFTAETERNGAKQAARGTAGNLTEAILAPLIPGWSGWDLDRKDRVFSDLWAARQDRSALLALIGDPRGPTRVTEDETAEAVADAIQIVLPTGRASLSAKAARAIAQAMAPGIGYDEAVTLALGLHHSHRPRQERLARLPYYAAALPDVGLDGDPVGPPPAEDDGAAAEAYYGRIGNISVHIALNETRKIVNALLHRHGPILRLVMVETTRELKAGADERKRMIAEQAERERENAEIDVELRKSDRWMANARERRQRVRLARRQNNLCPYTSTPIGHADLLGDAYDIDHVIPLARGGRDSLDNMVLCQSDANKTKGDKTPWEAFHDKPGWIAQRDDFLARLDPQTAKALAWRFADDAGERVARKSAEDEDQGFLPRQLTDTGYIARVALRYLSLVTNEPNAVVATNGRLTGLLRLAWDITPGPAPRDLLPTPRDALRDDTAARRFLDGLTPPPLAKAVEGAVQARLAALGRSRVADAGLADALGLTLASLGGGGKNRADHRHHFIDAAMIAVTTRGLINQINQASGAGRILDLRKWPRTNFEPPYPTFRAEVMKQWDHIHPSIRPAHRDGGSLHAATVFGVRNRPDARVLVQRKPVEKLFLDANAKPLPADKIAEIIDGFASPRMAKRFKALLARYQAAHPEVPPALAALAVARDPAFGPRGMTANTVIAGRSDGDGEDAGLITPFRANPKAAVRTMGNAVYEVWEIQVKGRPRWTHRVLTRFDRTQPAPPPPPENARLVMRLRRGDLVYWPLESGDRLFLVKKMAVDGRLALWPARLATGKATALYAQLSCPNINLNGDQGYCVQSAEGIRKEKIRTTSCTALGRLRLSKKAT

SEQ ID NO: 69 - protein, 1021 aa, Clostridium cellulolyticum H10
MKYTLGLDVGIASVGWAVIDKDNNKIIDLGVRCFDKAEESKTGESLATARRIARGMRRRISRRSQRLRLVKKLFVQYEIIKDSSEFNRIFDTSRDGWKDPWELRYNALSRILKPYELVQVLTHITKRRGFKSNRKEDLSTTKEGVVITSIKNNSEMLRTKNYRTIGEMIFMETPENSNKRNKVDEYIHTIAREDLLNEIKYIFSIQRKLGSPFVTEKLEHDFLNIWEFQRPFASGDSILSKVGKCTLLKEELRAPTSCYTSEYFGLLQSINNLVLVEDNNTLTLNNDQRAKIIEYAHFKNEIKYSEIRKLLDIEPEILFKAHNLTHKNPSGNNESKKFYEMKSYHKLKSTLPTDIWGKLHSNKESLDNLFYCLTVYKNDNEIKDYLQANNLDYLIEYIAKLPTFNKFKHLSLVAMKRIIPFMEKGYKYSDACNMAELDFTGSSKLEKCNKLTVEPIIENVTNPVVIRALTQARKVINAIIQKYGLPYMVNIELAREAGMTRQDRDNLKKEHENNRKAREKISDLIRQNGRVASGLDILKWRLWEDQGGRCAYSGKPIPVCDLLNDSLTQIDHIYPYSRSMDDSYMNKVLVLTDENQNKRSYTPYEVWGSTEKWEDFEARIYSMHLPQSKEKRLLNRNFITKDLDSFISRNLNDTRYISRFLKNYIESYLQFSNDSPKSCVVCVNGQCTAQLRSRWGLNKNREESDLHHALDAAVIACADRKIIKEITNYYNERENHNYKVKYPLPWHSFRQDLMETLAGVFISRAPRRKITGPAHDETIRSPKHFNKGLTSVKIPLTTVTLEKLETMVKNTKGGISDKAVYNVLKNRLIEHNNKPLKAFAEKIYKPLKNGTNGAIIRSIRVETPSYTGVFRNEGKGISDNSLMVRVDVFKKKDKYYLVPIYVAHMIKKELPSKAIVPLKPESQWELIDSTHEFLFSLYQNDYLVIKTKKGITEGYYRSCHRGTGSLSLMPHFANNKNVKIDIGVRTAISIEKYNVDILGNKSIVKGEPRRGMEKYNSFKSN

SEQ ID NO: 70 - protein, 1024 aa, Helicobacter mustelae 12198
MIRTLGIDIGIASIGWAVIEGEYTDKGLENKEIVASGVRVFTKAENPKNKESLALPRTLARSARRRNARKKGRIQQVKHYLSKALGLDLECFVQGEKLATLFQTSKDFLSPWELRERALYRVLDKEELARVILHIAKRRGYDDITYGVEDNDSGKIKKAIAENSKRIKEEQCKTIGEMMYKLYFQKSLNVRNKKESYNRCVGRSELREELKTIFQIQQELKSPWVNEELIYKLLGNPDAQSKQEREGLIFYQRPLKGFGDKIGKCSHIKKGENSPYRACKHAPSAEEFVALTKSINFLKNLTNRHGLCFSQEDMCVYLGKILQEAQKNEKGLTYSKLKLLLDLPSDFEFLGLDYSGKNPEKAVFLSLPSTFKLNKITQDRKTQDKIANILGANKDWEAILKELESLQLSKEQIQTIKDAKLNFSKHINLSLEALYHLLPLMREGKRYDEGVEILQERGIFSKPQPKNRQLLPPLSELAKEESYFDIPNPVLRRALSEFRKVVNALLEKYGGFHYFHIELTRDVCKAKSARMQLEKINKKNKSENDAASQLLEVLGLPNTYNNRLKCKLWKQQEEYCLYSGEKITIDHLKDQRALQIDHAFPLSRSLDDSQSNKVLCLTSSNQEKSNKTPYEWLGSDEKKWDMYVGRVYSSNFSPSKKRKLTQKNFKERNEEDFLARNLVDTGYIGRVTKEYIKHSLSFLPLPDGKKEHIRIISGSMTSTMRSFWGVQEKNRDHHLHHAQDAIIIACIEPSMIQKYTTYLKDKETHRLKSHQKAQILREGDHKLSLRWPMSNFKDKIQESIQNIIPSHHVSHKVTGELHQETVRTKEFYYQAFGGEEGVKKALKFGKIREINQGIVDNGAMVRVDIFKSKDKGKFYAVPIYTYDFAIGKLPNKAIVQGKKNGIIKDWLEMDENYEFCFSLFKNDCIKIQTKEMQEAVLAIYKSTNSAKATIELEHLSKYALKNEDEEKMFTDTDKEKNKTMTRESCGIQGLKVFQKVKLSVLGEVLEHKPRNRQNIALKTTPKHV

SEQ ID NO: 71 - protein, 1092 aa, Ilyobacter polytropus DSM 2926
MKYSIGLDIGIASVGWSVINKDKERIEDMGVRIFQKAENPKDGSSLASSRREKRGSRRRNRRKKHRLDRIKNILCESGLVKKNEIEKIYKNAYLKSPWELRAKSLEAKISNKEIAQILLHIAKRRGFKSFRKTDRNADDTGKLLSGIQENKKIMEEKGYLTIGDMVAKDPKFNTHVRNKAGSYLFSFSRKLLEDEVRKIQAKQKELGNTHFTDDVLEKYIEVFNSQRNFDEGPSKPSPYYSEIGQIAKMIGNCTFESSEKRTAKNTWSGERFVFLQKLNNFRIVGLSGKRPLTEEERDIVEKEVYLKKEVRYEKLRKILYLKEEERFGDLNYSKDEKQDKKTEKTKFISLIGNYTIKKLNLSEKLKSEIEEDKSKLDKIIEILTFNKSDKTIESNLKKLELSREDIEILLSEEFSGTLNLSLKAIKKILPYLEKGLSYNEACEKADYDYKNNGIKFKRGELLPVVDKDLIANPVVLRAISQTRKVVNAIIRKYGTPHTIHVEVARDLAKSYDDRQTIIKENKKRELENEKTKKFISEEFGIKNVKGKLLLKYRLYQEQEGRCAYSRKELSLSEVILDESMTDIDHIIPYSRSMDDSYSNKVLVLSGENRKKSNLLPKEYFDRQGRDWDTFVLNVKAMKIHPRKKSNLLKEKFTREDNKDWKSRALNDTRYISRFVANYLENALEYRDDSPKKRVFMIPGQLTAQLRARWRLNKVRENGDLHHALDAAVVAVTDQKAINNISNISRYKELKNCKDVIPSIEYHADEETGEVYFEEVKDTRFPMPWSGFDLELQKRLESENPREEFYNLLSDKRYLGWFNYEEGFIEKLRPVFVSRMPNRGVKGQAHQETIRSSKKISNQIAVSKKPLNSIKLKDLEKMQGRDTDRKLYEALKNRLEEYDDKPEKAFAEPFYKPTNSGKRGPLVRGIKVEEKQNVGVYVNGGQASNGSMVRIDVFRKNGKFYTVPIYVHQTLLKELPNRAINGKPYKDWDLIDGSFEFLYSFYPNDLIEIEFGKSKSIKNDNKLTKTEIPEVNLSEVLGYYRGMDTSTGAATIDTQDGKIQMRIGIKTVKNIKKYQVDVLGNVYKVKREKRQTF

SEQ ID NO: 72 - protein, 1179 aa, Sphaerochaeta globus str. Buddy
MSKKVSRRYEEQAQEICQRLGSRPYSIGLDLGVGSIGVAVAAYDPIKKQPSDLVFVSSRIFIPSTGAAERRQKRGQRNSLRHRANRLKFLWKLLAERNLMLSYSEQDVPDPARLRFEDAVVRANPYELRLKGLNEQLTLSELGYALYHIANHRGSSSVRTFLDEEKSSDDKKLEEQQAMTEQLAKEKGISTFIEVLTAFNTNGLIGYRNSESVKSKGVPVPTRDIISNEIDVLLQTQKQFYQEILSDEYCDRIVSAILFENEKIVPEAGCCPYFPDEKKLPRCHFLNEERRLWEAINNARIKMPMQEGAAKRYQSASFSDEQRHILFHIARSGTDITPKLVQKEFPALKTSIIVLQGKEKAIQKIAGFRFRRLEEKSFWKRLSEEQKDDFFSAWTNTPDDKRLSKYLMKHLLLTENEVVDALKTVSLIGDYGPIGKTATQLLMKHLEDGLTYTEALERGMETGEFQELSVWEQQSLLPYYGQILTGSTQALMGKYWHSAFKEKRDSEGFFKPNTNSDEEKYGRIANPVVHQTLNELRKLMNELITILGAKPQEITVELARELKVGAEKREDIIKQQTKQEKEAVLAYSKYCEPNNLDKRYIERFRLLEDQAFVCPYCLEHISVADIAAGRADVDHIFPRDDTADNSYGNKVVAHRQCNDIKGKRTPYAAFSNTSAWGPIMHYLDETPGMWRKRRKFETNEEEYAKYLQSKGFVSRFESDNSYIAKAAKEYLRCLFNPNNVTAVGSLKGMETSILRKAWNLQGIDDLLGSRHWSKDADTSPTMRKNRDDNRHHGLDAIVALYCSRSLVQMINTMSEQGKRAVEIEAMIPIPGYASEPNLSFEAQRELFRKKILEFMDLHAFVSMKTDNDANGALLKDTVYSILGADTQGEDLVFVVKKKIKDIGVKIGDYEEVASAIRGRITDKQPKWYPMEMKDKIEQLQSKNEAALQKYKESLVQAAAVLEESNRKLIESGKKPIQLSEKTISKKALELVGGYYYLISNNKRTKTFVVKEPSNEVKGFAFDTGSNLCLDFYHDAQGKLCGEIIRKIQAMNPSYKPAYMKQGYSLYVRLYQGDVCELRASDLTEAESNLAKTTHVRLPNAKPGRTFVIIITFTEMGSGYQIYFSNLAKSKKGQDTSFTLTTIKNYDVRKVQLSSAGLVRYVSPLLVDKIEKDEVALCGE

SEQ ID NO: 73 - protein, 1054 aa, Staphylococcus lugdunensis M23590
MNQKFILGLDIGITSVGYGLIDYETKNIIDAGVRLFPEANVENNEGRRSKRGSRRLKRRRIHRLERVKKLLEDYNLLDQSQIPQSTNPYAIRVKGLSEALSKDELVIALLHIAKRRGIHKIDVIDSNDDVGNELSTKEQLNKNSKLLKDKFVCQIQLERMNEGQVRGEKNRFKTADIIKEIIQLLNVQKNFHQLDENFINKYIELVEMRREYFEGPGKGSPYGWEGDPKAWYETLMGHCTYFPDELRSVKYAYSADLFNALNDLNNLVIQRDGLSKLEYHEKYHIIENVFKQKKKPTLKQIANEINVNPEDIKGYRITKSGKPQFTEFKLYHDLKSVLFDQSILENEDVLDQIAEILTIYQDKDSIKSKLTELDILLNEEDKENIAQLTGYTGTHRLSLKCIRLVLEEQWYSSRNQMEIFTHLNIKPKKINLTAANKIPKAMIDEFILSPVVKRTFGQAINLINKIIEKYGVPEDIIIELARENNSKDKQKFINEMQKKNENTRKRINEIIGKYGNQNAKRLVEKIRLHDEQEGKCLYSLESIPLEDLLNNPNHYEVDHIIPRSVSFDNSYHNKVLVKQSENSKKSNLTPYQYFNSGKSKLSYNQFKQHILNLSKSQDRISKKKKEYLLEERDINKFEVQKEFINRNLVDTRYATRELTNYLKAYFSANNMNVKVKTINGSFTDYLRKVWKFKKERNHGYKHHAEDALIIANADFLFKENKKLKAVNSVLEKPEIESKQLDIQVDSEDNYSEMFIIPKQVQDIKDFRNFKYSHRVDKKPNRQLINDTLYSTRKKDNSTYIVQTIKDIYAKDNTTLKKQFDKSPEKFLMYQHDPRTFEKLEVIMKQYANEKNPLAKYHEETGEYLTKYSKKNNGPIVKSLKYIGNKLGSHLDVTHQFKSSTKKLVKLSIKPYRFDVYLTDKGYKFITISYLDVLKKDNYYYIPEQKYDKLKLGKAIDKNAKFIASFYKNDLIKLDGEIYKIIGVNSDTRNMIELDLPDIRYKEYCELNNIKGEPRIKKTIGKKVNSIEKLTTDVLGNVFTNTQYTKPQLLFKRGN

SEQ ID NO: 74 - protein, 1061 aa, Treponema sp. JC4
MIMKLEKWRLGLDLGTNSIGWSVFSLDKDNSVQDLIDMGVRIFSDGRDPKTKEPLAVARRTARSQRKLIYRRKLRRKQVFKFLQEQGLFPKTKEECMTLKSLNPYELRIKALDEKLEPYELGRALFNLAVRRGFKSNRKDGSREEVSEKKSPDEIKTQADMQTHLEKAIKENGCRTITEFLYKNQGENGGIRFAPGRMTYYPTRKMYEEEFNLIRSKQEKYYPQVDWDDIYKAIFYQRPLKPQQRGYCIYENDKERTFKAMPCSQKLRILQDIGNLAYYEGGSKKRVELNDNQDKVLYELLNSKDKVTFDQMRKALCLADSNSFNLEENRDFLIGNPTAVKMRSKNRFGKLWDEIPLEEQDLIIETIITADEDDAVYEVIKKYDLTQEQRDFIVKNTILQSGTSMLCKEVSEKLVKRLEEIADLKYHEAVESLGYKFADQTVEKYDLLPYYGKVLPGSTMEIDLSAPETNPEKHYGKISNPTVHVALNQTRVVVNALIKEYGKPSQIAIELSRDLKNNVEKKAEIARKQNQRAKENIAINDTISALYHTAFPGKSFYPNRNDRMKYRLWSELGLGNKCIYCGKGISGAELFTKEIEIEHILPFSRTLLDAESNLTVAHSSCNAFKAERSPFEAFGTNPSGYSWQEIIQRANQLKNTSKKNKFSPNAMDSFEKDSSFIARQLSDNQYIAKAALRYLKCLVENPSDVWTTNGSMTKLLRDKWEMDSILCRKFTEKEVALLGLKPEQIGNYKKNRFDHRHHAIDAVVIGLTDRSMVQKLATKNSHKGNRIEIPEFPILRSDLIEKVKNIVVSFKPDHGAEGKLSKETLLGKIKLHGKETFVCRENIVSLSEKNLDDIVDEIKSKVKDYVAKHKGQKIEAVLSDFSKENGIKKVRCVNRVQTPIEITSGKISRYLSPEDYFAAVIWEIPGEKKTFKAQYIRRNEVEKNSKGLNVVKPAVLENGKPHPAAKQVCLLHKDDYLEFSDKGKMYFCRIAGYAATNNKLDIRPVYAVSYCADWINSTNETMLTGYWKPTPTQNWVSVNVLFDKQKARLVTVSPIGRVFRK

SEQ ID NO: 75 - protein, 1011 aa, Uncultured delta proteobacterium HF0070 07E19
MSSKAIDSLEQLDLFKPQEYTLGLDLGIKSIGWAILSGERIANAGVYLFETAEELNSTGNKLISKAAERGRKRRIRRMLDRKARRGRHIRYLLEREGLPTDELEEVVVHQSNRTLWDVRAEAVERKLTKQELAAVLFHLVRHRGYFPNTKKLPPDDESDSADEEQGKINRATSRLREELKASDCKTIGQFLAQNRDRQRNREGDYSNLMARKLVFEEALQILAFQRKQGHELSKDFEKTYLDVLMGQRSGRSPKLGNCSLIPSELRAPSSAPSTEWFKFLQNLGNLQISNAYREEWSIDAPRRAQIIDACSQRSTSSYWQIRRDFQIPDEYRFNLVNYERRDPDVDLQEYLQQQERKTLANFRNWKQLEKIIGTGHPIQTLDEAARLITLIKDDEKLSDQLADLLPEASDKAITQLCELDFTTAAKISLEAMYRILPHMNQGMGFFDACQQESLPEIGVPPAGDRVPPFDEMYNPVVNRVLSQSRKLINAVIDEYGMPAKIRVELARDLGKGRELRERIKLDQLDKSKQNDQRAEDFRAEFQQAPRGDQSLRYRLWKEQNCTCPYSGRMIPVNSVLSEDTQIDHILPISQSFDNSLSNKVLCFTEENAQKSNRTPFEYLDAADFQRLEAISGNWPEAKRNKLLHKSFGKVAEEWKSRALNDTRYLTSALADHLRHHLPDSKIQTVNGRITGYLRKQWGLEKDRDKHTHHAVDAIVVACTTPAIVQQVTLYHQDIRRYKKLGEKRPTPWPETFRQDVLDVEEEIFITRQPKKVSGGIQTKDTLRKHRSKPDRQRVALTKVKLADLERLVEKDASNRNLYEHLKQCLEESGDQPTKAFKAPFYMPSGPEAKQRPILSKVTLLREKPEPPKQLTELSGGRRYDSMAQGRLDIYRYKPGGKRKDEYRVVLQRMIDLMRGEENVHVFQKGVPYDQGPEIEQNYTFLFSLYFDDLVEFQRSADSEVIRGYYRTFNIANGQLKISTYLEGRQDFDFFGANRLAHFAKVQVNLLGKVIK

SEQ ID NO: 76 - protein, 1029 aa, Alicycliphilus denitrificans K601
MRSLRYRLALDLGSTSLGWALFRLDACNRPTAVIKAGVRIFSDGRNPKDGSSLAVTRRAARAMRRRRDRLLKRKTRMQAKLVEHGFFPADAGKRKALEQLNPYALRAKGLQEALLPGEFARALFHINQRRGFKSNRKTDKKDNDSGVLKKAIGQLRQQMAEQGSRTVGEYLWTRLQQGQGVRARYREKPYTTEEGKKRIDKSYDLYIDRAMIEQEFDALWAAQAAFNPTLFHEAARADLKDTLLHQRPLRPVKPGRCTLLPEEERAPLALPSTQRFRIHQEVNHLRLLDENLREVALTLAQRDAVVTALETKAKLSFEQIRKLLKLSGSVQFNLEDAKRTELKGNATSAALARKELFGAAWSGFDEALQDEIVWQLVTEEGEGALIAWLQTHTGVDEARAQAIVDVSLPEGYGNLSRKALARIVPALRAAVITYDKAVQAAGFDHHSQLGFEYDASEVEDLVHPETGEIRSVFKQLPYYGKALQRHVAFGSGKPEDPDEKRYGKIANPTVHIGLNQVRMVVNALIRRYGRPTEVVIELARDLKQSREQKVEAQRRQADNQRRNARIRRSIAEVLGIGEERVRGSDIQKWICWEELSFDAADRRCPYSGVQISAAMLLSDEVEVEHILPFSKTLDDSLNNRTVAMRQANRIKRNRTPWDARAEFEAQGWSYEDILQRAERMPLRKRYRFAPDGYERWLGDDKDFLARALNDTRYLSRVAAEYLRLVCPGTRVIPGQLTALLRGKFGLNDVLGLDGEKNRNDHRHHAVDACVIGVTDQGLMQRFATASAQARGDGLTRLVDGMPMPWPTYRDHVERAVRHIWVSHRPDHGFEGAMMEETSYGIRKDGSIKQRRKADGSAGREISNLIRIHEATQPLRHGVSADGQPLAYKGYVGGSNYCIEITVNDKGKWEGEVISTFRAYGVVRAGGMGRLRNPHEGQNGRKLIMRLVIGDSVRLEVDGAERTMRIVKISGSNGQIFMAPIHEANVDARNTDKQDAFTYTSKYAGSLQKAKTRRVTISPIGEVRDPGFKG

SEQ ID NO: 77 - protein, 1168 aa, Azospirillum sp. B510
MARPAFRAPRREHVNGWTPDPHRISKPFFILVSWHLLSRVVIDSSSGCFPGTSRDHTDKFAEWECAVQPYRLSFDLGTNSIGWGLLNLDRQGKPREIRALGSRIFSDGRDPQDKASLAVARRLARQMRRRRDRYLTRRTRLMGALVRFGLMPADPAARKRLEVAVDPYLARERATRERLEPFEIGRALFHLNQRRGYKPVRTATKPDEEAGKVKEAVERLEAAIAAAGAPTLGAWFAWRKTRGETLRARLAGKGKEAAYPFYPARRMLEAEFDTLWAEQARHHPDLLTAEAREILRHRIFHQRPLKPPPVGRCTLYPDDGRAPRALPSAQRLRLFQELASLRVIHLDLSERPLTPAERDRIVAFVQGRPPKAGRKPGKVQKSVPFEKLRGLLELPPGTGFSLESDKRPELLGDETGARIAPAFGPGWTALPLEEQDALVELLLTEAEPERAIAALTARWALDEATAAKLAGATLPDFHGRYGRRAVAELLPVLERETRGDPDGRVRPIRLDEAVKLLRGGKDHSDFSREGALLDALPYYGAVLERHVAFGTGNPADPEEKRVGRVANPTVHIALNQLRHLVNAILARHGRPEEIVIELARDLKRSAEDRRREDKRQADNQKRNEERKRLILSLGERPTPRNLLKLRLWEEQGPVENRRCPYSGETISMRMLLSEQVDIDHILPFSVSLDDSAANKVVCLREANRIKRNRSPWEAFGHDSERWAGILARAEALPKNKRWRFAPDALEKLEGEGGLRARHLNDTRHLSRLAVEYLRCVCPKVRVSPGRLTALLRRRWGIDAILAEADGPPPEVPAETLDPSPAEKNRADHRHHALDAVVIGCIDRSMVQRVQLAAASAEREAAAREDNIRRVLEGFKEEPWDGFRAELERRARTIVVSHRPEHGIGGALHKETAYGPVDPPEEGFNLVVRKPIDGLSKDEINSVRDPRLRRALIDRLAIRRRDANDPATALAKAAEDLAAQPASRGIRRVRVLKKESNPIRVEHGGNPSGPRSGGPFHKLLLAGEVHHVDVALRADGRRWVGHWVTLFEAHGGRGADGAAAPPRLGDGERFLMRLHKGDCLKLEHKGRVRVMQVVKLEPSSNSVVVVEPHQVKTDRSKHVKISCDQLRARGARRVTVDPLGRVRVHAPGARVGIGGDAGRTAMEPAEDIS

SEQ ID NO: 78 - protein, 1064 aa, Bradyrhizobium sp. BTAi1
MKRTSLRAYRLGVDLGANSLGWFVVWLDDHGQPEGLGPGGVRIFPDGRNPQSKQSNAAGRRLARSARRRRDRYLQRRGKLMGLLVKHGLMPADEPARKRLECLDPYGLRAKALDEVLPLHHVGRALFHLNQRRGLFANRAIEQGDKDASAIKAAAGRLQTSMQACGARTLGEFLNRRHQLRATVRARSPVGGDVQARYEFYPTRAMVDAEFEAIWAAQAPHHPTMTAEAHDTIREAIFSQRAMKRPSIGKCSLDPATSQDDVDGFRCAWSHPLAQRFRIWQDVRNLAVVETGPTSSRLGKEDQDKVARALLQTDQLSFDEIRGLLGLPSDARFNLESDRRDHLKGDATGAILSARRHFGPAWHDRSLDRQIDIVALLESALDEAAIIASLGTTHSLDEAAAQRALSALLPDGYCRLGLRAIKRVLPLMEAGRTYAEAASAAGYDHALLPGGKLSPTGYLPYYGQWLQNDVVGSDDERDTNERRWGRLPNPTVHIGIGQLRRVVNELIRWHGPPAEITVELTRDLKLSPRRLAELEREQAENQRKNDKRTSLLRKLGLPASTHNLLKLRLWDEQGDVASECPYTGEAIGLERLVSDDVDIDHLIPFSISWDDSAANKVVCMRYANREKGNRTPFEAFGHRQGRPYDWADIAERAARLPRGKRWRFGPGARAQFEELGDFQARLLNETSWLARVAKQYLAAVTHPHRIHVLPGRLTALLRATWELNDLLPGSDDRAAKSRKDHRHHAIDALVAALTDQALLRRMANAHDDTRRKIEVLLPWPTFRIDLETRLKAMLVSHKPDHGLQARLHEDTAYGTVEHPETEDGANLVYRKTFVDISEKEIDRIRDRRLRDLVRAHVAGERQQGKTLKAAVLSFAQRRDIAGHPNGIRHVRLTKSIKPDYLVPIRDKAGRIYKSYNAGENAFVDILQAESGRWIARATTVFQANQANESHDAPAAQPIMRVFKGDMLRIDHAGAEKFVKIVRLSPSNNLLYLVEHHQAGVFQTRHDDPEDSFRWLFASFDKLREWNAELVRIDTLGQPWRRKRGLETGSEDATRIGWTRPKKWP

SEQ ID NO: 79 - protein, 1037 aa, Parvibaculum lavamentivorans DS1
MERIFGFDIGTTSIGFSVIDYSSTQSAGNIQRLGVRIFPEARDPDGTPLNQQRRQKRMMRRQLRRRRIRRKALNETLHEAGFLPAYGSADWPVVMADEPYELRRRGLEEGLSAYEFGRAIYHLAQHRHFKGRELEESDTPDPDVDDEKEAANERAATLKALKNEQTTLGAWLARRPPSDRKRGIHAHRNVVAEEFERLWEVQSKFHPALKSEEMRARISDTIFAQRPVFWRKNTLGECRFMPGEPLCPKGSWLSQQRRMLEKLNNLAIAGGNARPLDAEERDAILSKLQQQASMSWPGVRSALKALYKQRGEPGAEKSLKFNLELGGESKLLGNALEAKLADMFGPDWPAHPRKQEIRHAVHERLWAADYGETPDKKRVIILSEKDRKAHREAAANSFVADFGITGEQAAQLQALKLPTGWEPYSIPALNLFLAELEKGERFGALVNGPDWEGWRRTNFPHRNQPTGEILDKLPSPASKEERERISQLRNPTVVRTQNELRKVVNNLIGLYGKPDRIRIEVGRDVGKSKREREEIQSGIRRNEKQRKKATEDLIKNGIANPSRDDVEKWILWKEGQERCPYTGDQIGFNALFREGRYEVEHIWPRSRSFDNSPRNKTLCRKDVNIEKGNRMPFEAFGHDEDRWSAIQIRLQGMVSAKGGTGMSPGKVKRFLAKTMPEDFAARQLNDTRYAAKQILAQLKRLWPDMGPEAPVKVEAVTGQVTAQLRKLWTLNNILADDGEKTRADHRHHAIDALTVACTHPGMTNKLSRYWQLRDDPRAEKPALTPPWDTIRADAEKAVSEIVVSHRVRKKVSGPLHKETTYGDTGTDIKTKSGTYRQFVTRKKIESLSKGELDEIRDPRIKEIVAAHVAGRGGDPKKAFPPYPCVSPGGPEIRKVRLTSKQQLNLMAQTGNGYADLGSNHHIAIYRLPDGKADFEIVSLFDASRRLAQRNPIVQRTRADGASFVMSLAAGEAIMIPEGSKKGIWIVQGVWASGQVVLERDTDADHSTTTRPMPNPILKDDAKKVSIDPIGRVRPSND

SEQ ID NO: 80 - protein, 1218 aa, Prevotella timonensis CRIS 5CB1
MNKRILGLDTGTNSLGWAVVDWDEHAQSYELIKYGDVIFQEGVKIEKGIESSKAAERSGYKAIRKQYFRRRLRKIQVLKVLVKYHLCPYLSDDDLRQWHLQKQYPKSDELMLWQRTSDEEGKNPYYDRHRCLHEKLDLTVEADRYTLGRALYHLTQRRGFLSNRLDTSADNKEDGVVKSGISQLSTEMEEAGCEYLGDYFYKLYDAQGNKVRIRQRYTDRNKHYQHEFDAICEKQELSSELIEDLQRAIFFQLPLKSQRHGVGRCTFERGKPRCADSHPDYEEFRMLCFVNNIQVKGPHDLELRPLTYEEREKIEPLFFRKSKPNFDFEDIAKALAGKKNYAWIHDKEERAYKFNYRMTQGVPGCPTIAQLKSIFGDDWKTGIAETYTLIQKKNGSKSLQEMVDDVWNVLYSFSSVEKLKEFAHHKLQLDEESAEKFAKIKLSHSFAALSLKAIRKFLPFLRKGMYYTHASFFANIPTIVGKEIWNKEQNRKYIMENVGELVFNYQPKHREVQGTIEMLIKDFLANNFELPAGATDKLYHPSMIETYPNAQRNEFGILQLGSPRTNAIRNPMAMRSLHILRRVVNQLLKESIIDENTEVHVEYARELNDANKRRAIADRQKEQDKQHKKYGDEIRKLYKEETGKDIEPTQTDVLKFQLWEEQNHHCLYTGEQIGITDFIGSNPKFDIEHTIPQSVGGDSTQMNLTLCDNRFNREVKKAKLPTELANHEEILTRIEPWKNKYEQLVKERDKQRTFAGMDKAVKDIRIQKRHKLQMEIDYWRGKYERFTMTEVPEGFSRRQGTGIGLISRYAGLYLKSLFHQADSRNKSNVYVVKGVATAEFRKMWGLQSEYEKKCRDNHSHHCMDAITIACIGKREYDLMAEYYRMEETFKQGRGSKPKFSKPWATFTEDVLNIYKNLLVVHDTPNNMPKHTKKYVQTSIGKVLAQGDTARGSLHLDTYYGAIERDGEIRYVVRRPLSSFTKPEELENIVDETVKRTIKEAIADKNFKQAIAEPIYMNEEKGILIKKVRCFAKSVKQPINIRQHRDLSKKEYKQQYHVMNENNYLLAIYEGLVKNKVVREFEIVSYIEAAKYYKRSQDRNIFSSIVPTHSTKYGLPLKTKLLMGQLVLMFEENPDEIQVDNTKDLVKRLYKVVGIEKDGRIKFKYHQEARKEGLPIFSTPYKNNDDYAPIFRQSINNINILVDGIDFTIDILGKVTLKE

SEQ ID NO: 81 - protein, 1088 aa, Bacillus smithii 7 3 47FAA
MNYKMGLDIGIASVGWAVINLDLKRIEDLGVRIFDKAEHPQNGESLALPRRIARSARRRLRRRKHRLERIRRLLVSENVLTKEEMNLLFKQKKQIDVWQLRVDALERKLNNDELARVLLHLAKRRGFKSNRKSERNSKESSEFLKNIEENQSILAQYRSVGEMIVKDSKFAYHKRNKLDSYSNMIARDDLEREIKLIFEKQREFNNPVCTERLEEKYLNIWSSQRPFASKEDIEKKVGFCTFEPKEKRAPKATYTFQSFIVWEHINKLRLVSPDETRALTEIERNLLYKQAFSKNKMTYYDIRKLLNLSDDIHFKGLLYDPKSSLKQIENIRFLELDSYHKIRKCIENVYGKDGIRMFNETDIDTFGYALTIFKDDEDIVAYLQNEYITKNGKRVSNLANKVYDKSLIDELLNLSFSKFAHLSMKAIRNILPYMEQGEIYSKACELAGYNFTGPKKKEKALLLPVIPNIANPVVMRALTQSRKVVNAIIKKYGSPVSIHIELARDLSHSFDERKKIQKDQTENRKKNETAIKQLIEYELTKNPTGLDIVKFKLWSEQQGRCMYSLKPIELERLLEPGYVEVDHILPYSRSLDDSYANKVLVLTKENREKGNHTPVEYLGLGSERWKKFEKFVLANKQFSKKKKQNLLRLRYEETEEKEFKERNLNDTRYISKFFANFIKEHLKFADGDGGQKVYTINGKITAHLRSRWDFNKNREESDLHHAVDAVIVACATQGMIKKITEFYKAREQNKESAKKKEPIFPQPWPHFADELKARLSKFPQESIEAFALGNYDRKKLESLRPVFVSRMPKRSVTGAAHQETLRRCVGIDEQSGKIQTAVKTKLSDIKLDKDGHFPMYQKESDPRTYEAIRQRLLEHNNDPKKAFQEPLYKPKKNGEPGPVIRTVKIIDTKNKVVHLDGSKTVAYNSNIVRTDVFEKDGKYYCVPVYTMDIMKGTLPNKAIEANKPYSEWKEMTEEYTFQFSLFPNDLVRIVLPREKTIKTSTNEEIIIKDIFAYYKTIDSATGGLELISHDRNFSLRGVGSKTLKRFEKYQVDVLGNIHKVKGEKRVGLAAPTNQKKGKTVDSLQSVSD

SEQ ID NO: 82 - protein, 1035 aa, Cand. Puniceispirillum marinum IMCC1322
MRRLGLDLGTNSIGWCLLDLGDDGEPVSIFRTGARIFSDGRDPKSLGSLKATRREARLTRRRRDRFIQRQKNLINALVKYGLMPADEIQRQALAYKDPYPIRKKALDEAIDPYEMGRAIFHINQRRGFKSNRKSADNEAGVVKQSIADLEMKLGEAGARTIGEFLADRQATNDTVRARRLSGTNALYEFYPDRYMLEQEFDTLWAKQAAFNPSLYIEAARERLKEIVFFQRKLKPQEVGRCIFLSDEDRISKALPSFQRFRIYQELSNLAWIDHDGVAHRITASLALRDHLFDELEHKKKLTFKAMRAILRKQGVVDYPVGFNLESDNRDHLIGNLTSCIMRDAKKMIGSAWDRLDEEEQDSFILMLQDDQKGDDEVRSILTQQYGLSDDVAEDCLDVRLPDGHGSLSKKAIDRILPVLRDQGLIYYDAVKEAGLGEANLYDPYAALSDKLDYYGKALAGHVMGASGKFEDSDEKRYGTISNPTVHIALNQVRAVVNELIRLHGKPDEVVIEIGRDLPMGADGKRELERFQKEGRAKNERARDELKKLGHIDSRESRQKFQLWEQLAKEPVDRCCPFTGKMMSISDLFSDKVEIEHLLPFSLTLDDSMANKTVCFRQANRDKGNRAPFDAFGNSPAGYDWQEILGRSQNLPYAKRWRFLPDAMKRFEADGGFLERQLNDTRYISRYTTEYISTIIPKNKIWVVTGRLTSLLRGFWGLNSILRGHNTDDGTPAKKSRDDHRHHAIDAIVVGMTSRGLLQKVSKAARRSEDLDLTRLFEGRIDPWDGFRDEVKKHIDAIIVSHRPRKKSQGALHNDTAYGIVEHAENGASTVVHRVPITSLGKQSDIEKVRDPLIKSALLNETAGLSGKSFENAVQKWCADNSIKSLRIVETVSIIPITDKEGVAYKGYKGDGNAYMDIYQDPTSSKWKGEIVSRFDANQKGFIPSWQSQFPTARLIMRLRINDLLKLQDGEIEEIYRVQRLSGSKILMAPHTEANVDARDRDKNDTFKLTSKSPGKLQSASARKVHISPTGLIREG

SEQ ID NO: 83 - protein, 1153 aa, Barnesiella intestinihominis YIT 11860
MKNILGLDLGLSSIGWSVIRENSEEQELVAMGSRVVSLTAAELSSFTQGNGVSINSQRTQKRTQRKGYDRYQLRRTLLRNKLDTLGMLPDDSLSYLPKLQLWGLRAKAVTQRIELNELGRVLLHLNQKRGYKSIKSDFSGDKKITDYVKTVKTRYDELKEMRLTIGELFFRRLTENAFFRCKEQVYPRQAYVEEFDCIMNCQRKFYPDILTDETIRCIRDEIIYYQRPLKSCKYLVSRCEFEKRFYLNAAGKKTEAGPKVSPRTSPLFQVCRLWESINNIVVKDRRNEIVFISAEQRAALFDFLNTHEKLKGSDLLKLLGLSKTYGYRLGEQFKTGIQGNKTRVEIERALGNYPDKKRLLQFNLQEESSSMVNTETGEIIPMISLSFEQEPLYRLWHVLYSIDDREQLQSVLRQKFGIDDDEVLERLSAIDLVKAGFGNKSSKAIRRILPFLQLGMNYAEACEAAGYNHSNNYTKAENEARALLDRLPAIKKNELRQPVVEKILNQMVNVVNALMEKYGRFDEIRVELARELKQSKEERSNTYKSINKNQRENEQIAKRIVEYGVPTRSRIQKYKMWEESKHCCIYCGQPVDVGDFLRGFDVEVEHIIPKSLYFDDSFANKVCSCRSCNKEKNNRTAYDYMKSKGEKALSDYVERVNTMYTNNQISKTKWQNLLTPVDKISIDFIDRQLRESQYIARKAKEILTSICYNVTATSGSVTSFLRHVWGWDTVLHDLNFDRYKKVGLTEVIEVNHRGSVIRREQIKDWSKRFDHRHHAIDALTIACTKQAYIQRLNNLRAEEGPDFNKMSLERYIQSQPHFSVAQVREAVDRILVSFRAGKRAVTPGKRYIRKNRKRISVQSVLIPRGALSEESVYGVIHVWEKDEQGHVIQKQRAVMKYPITSINREMLDKEKVVDKRIHRILSGRLAQYNDNPKEAFAKPVYIDKECRIPIRTVRCFAKPAINTLVPLKKDDKGNPVAWVNPGNNHHVAIYRDEDGKYKERTVTFWEAVDRCRVGIPAIVTQPDTIWDNILQRNDISENVLESLPDVKWQFVLSLQQNEMFILGMNEEDYRYAMDQQDYALLNKYLYRVQKLSKSDYSFRYHTETSVEDKYDGKPNLKLSMQMGKLKRVSIKSLLGLNPHKVHISVLGEIKEIS

SEQ ID NO: 84 - protein, 1062 aa, Ralstonia syzygii R24
MAEKQHRWGLDIGTNSIGWAVIALIEGRPAGLVATGSRIFSDGRNPKDGSSLAVERRGPRQMRRRRDRYLRRRDRFMQALINVGLMPGDAAARKALVTENPYVLRQRGLDQALTLPEFGRALFHLNQRRGFQSNRKTDRATAKESGKVKNAIAAFRAGMGNARTVGEALARRLEDGRPVRARMVGQGKDEHYELYIAREWIAQEFDALWASQQRFHAEVLADAARDRLRAILLFQRKLLPVPVGKCFLEPNQPRVAAALPSAQRFRLMQELNHLRVMTLADKRERPLSFQERNDLLAQLVARPKCGFDMLRKIVFGANKEAYRFTIESERRKELKGCDTAAKLAKVNALGTRWQALSLDEQDRLVCLLLDGENDAVLADALREHYGLTDAQIDTLLGLSFEDGHMRLGRSALLRVLDALESGRDEQGLPLSYDKAVVAAGYPAHTADLENGERDALPYYGELLWRYTQDAPTAKNDAERKFGKIANPTVHIGLNQLRKLVNALIQRYGKPAQIVVELARNLKAGLEEKERIKKQQTANLERNERIRQKLQDAGVPDNRENRLRMRLFEELGQGNGLGTPCIYSGRQISLQRLFSNDVQVDHILPFSKTLDDSFANKVLAQHDANRYKGNRGPFEAFGANRDGYAWDDIRARAAVLPRNKRNRFAETAMQDWLHNETDFLARQLTDTAYLSRVARQYLTAICSKDDVYVSPGRLTAMLRAKWGLNRVLDGVMEEQGRPAVKNRDDHRHHAIDAVVIGATDRAMLQQVATLAARAREQDAERLIGDMPTPWPNFLEDVRAAVARCVVSHKPDHGPEGGLHNDTAYGIVAGPFEDGRYRVRHRVSLFDLKPGDLSNVRCDAPLQAELEPIFEQDDARAREVALTALAERYRQRKVWLEELMSVLPIRPRGEDGKTLPDSAPYKAYKGDSNYCYELFINERGRWDGELISTFRANQAAYRRFRNDPARFRRYTAGGRPLLMRLCINDYIAVGTAAERTIFRVVKMSENKITLAEHFEGGTLKQRDADKDDPFKYLTKSPGALRDLGARRIFVDLIGRVLDPGIKGD

SEQ ID NO: 85 - protein, 1060 aa, Homo sapiens
MEQLNELELLMEKSFWEEAELPAELFQKKVVASFPRTVLSTGMDNRYLVLAVNTVQNKEGNCEKRLVITASQSLENKELCILRNDWCSVPVEPGDIIHLEGDCTSDTWIIDKDFGYLILYPDMLISGTSIASSIRCMRRAVLSETFRSSDPATRQMLIGTVLHEVFQKAINNSFAPEKLQELAFQTIQEIRHLKEMYRLNLSQDEIKQEVEDYLPSFCKWAGDFMHKNTSTDFPQMQLSLPSDNSKDNSTCNIEVVKPMDIEESIWSPRFGLKGKIDVTVGVKIHRGYKTKYKIMPLELKTGKESNSIEHRSQVVLYTLLSQERRADPEAGLLLYLKTGQMYPVPANHLDKRELLKLRNQMAFSLFHRISKSATRQKTQLASLPQIIEEEKTCKYCSQIGNCALYSRAVEQQMDCSSVPIVMLPKIEEETQHLKQTHLEYFSLWCLMLTLESQSKDNKKNHQNIWLMPASEMEKSGSCIGNLIRMEHVKIVCDGQYLHNFQCKHGAIPVTNLMAGDRVIVSGEERSLFALSRGYVKEINMTTVTCLLDRNLSVLPESTLFRLDQEEKNCDIDTPLGNLSKLMENTFVSKKLRDLIIDFREPQFISYLSSVLPHDAKDTVACILKGLNKPQRQAMKKVLLSKDYTLIVGMPGTGKTTTICTLVRILYACGFSVLLTSYTHSAVDNILLKLAKFKIGFLRLGQIQKVHPAIQQFTEQEICRSKSIKSLALLEELYNSQLIVATTCMGINHPIFSRKIFDFCIVDEASQISQPICLGPLFFSRRFVLVGDHQQLPPLVLNREARALGMSESLFKRLEQNKSAVVQLTVQYRMNSKIMSLSNKLTYEGKLECGSDKVANAVINLRHFKDVKLELEFYADYSDNPWLMGVFEPNNPVCFLNTDKVPAPEQVEKGGVSNVTEAKLIVFLTSIFVKAGCSPSDIGIIAPYRQQLKIINDLLARSIGMVEVNTVDKYQGRDKSIVLVSFVRSNKDGTVGELLKDWRRLNVAITRAKHKLILLGCVPSLNCYPPLEKLLNHLNSEKLIIDLPSREHESLCHILGDFQRE

SEQ ID NO: 86 - protein, 1059 aa, Wolinella succinogenes DSM 1740
MIERILGVDLGISSLGWAIVEYDKDDEAANRIIDCGVRLFTAAETPKKKESPNKARREARGIRRVLNRRRVRMNMIKKLFLRAGLIQDVDLDGEGGMFYSKANRADVWELRHDGLYRLLKGDELARVLIHIAKHRGYKFIGDDEADEESGKVKKAGVVLRQNFEAAGCRTVGEWLWRERGANGKKRNKHGDYEISIHRDLLVEEVEAIFVAQQEMRSTIATDALKAAYREIAFFVRPMQRIEKMVGHCTYFPEERRAPKSAPTAEKFIAISKFFSTVIIDNEGWEQKIIERKTLEELLDFAVSREKVEFRHLRKFLDLSDNEIFKGLHYKGKPKTAKKREATLFDPNEPTELEFDKVEAEKKAWISLRGAAKLREALGNEFYGRFVALGKHADEATKILTYYKDEGQKRRELTKLPLEAEMVERLVKIGFSDFLKLSLKAIRDILPAMESGARYDEAVLMLGVPHKEKSAILPPLNKTDIDILNPTVIRAFAQFRKVANALVRKYGAFDRVHFELAREINTKGEIEDIKESQRKNEKERKEAADWIAETSFQVPLTRKNILKKRLYIQQDGRCAYTGDVIELERLFDEGYCEIDHILPRSRSADDSFANKVLCLARANQQKTDRTPYEWFGHDAARWNAFETRTSAPSNRVRTGKGKIDRLLKKNFDENSEMAFKDRNLNDTRYMARAIKTYCEQYWVFKNSHTKAPVQVRSGKLTSVLRYQWGLESKDRESHTHHAVDAIIIAFSTQGMVQKLSEYYRFKETHREKERPKLAVPLANFRDAVEEATRIENTETVKEGVEVKRLLISRPPRARVTGQAHEQTAKPYPRIKQVKNKKKWRLAPIDEEKFESFKADRVASANQKNFYETSTIPRVDVYHKKGKFHLVPIYLHEMVLNELPNLSLGTNPEAMDENFFKFSIFKDDLISIQTQGTPKKPAKIIMGYFKNMHGANMVLSSINNSPCEGFTCTPVSMDKKHKDKCKLCPEENRIAGRCLQGFLDYWSQEGLRPPRKEFECDQGVKFALDVKKYQIDPLGYYYEVKQEKRLGTIPQMRSAKKLVKK

SEQ ID NO: 87 - protein, 1269 aa, Mycoplasma gallisepticum str. F
MNNSIKSKPEVTIGLDLGVGSVGWAIVDNETNIIHHLGSRLFSQAKTAEDRRSFRGVRRLIRRRKYKLKRFVNLIWKYNSYFGFKNKEDILNNYQEQQKLHNTVLNLKSEALNAKIDPKALSWILHDYLKNRGHFYEDNRDFNVYPTKELAKYFDKYGYYKGIIDSKEDNDNKLEEELTKYKFSNKHWLEEVKKVLSNQTGLPEKFKEEYESLFSYVRNYSEGPGSINSVSPYGIYHLDEKEGKVVQKYNNIWDKTIGKCNIFPDEYRAPKNSPIAMIFNEINELSTIRSYSIYLTGWFINQEFKKAYLNKLLDLLIKTNGEKPIDARQFKKLREETIAESIGKETLKDVENEEKLEKEDHKWKLKGLKLNTNGKIQYNDLSSLAKFVHKLKQHLKLDFLLEDQYATLDKINFLQSLFVYLGKHLRYSNRVDSANLKEFSDSNKLFERILQKQKDGLFKLFEQTDKDDEKILAQTHSLSTKAMLLAITRMTNLDNDEDNQKNNDKGWNFEAIKNFDQKFIDITKKNNNLSLKQNKRYLDDRFINDAILSPGVKRILREATKVFNAILKQFSEEYDVTKVVIELARELSEEKELENTKNYKKLIKKNGDKISEGLKALGISEDEIKDILKSPTKSYKFLLWLQQDHIDPYSLKEIAFDDIFTKTEKFEIDHIIPYSISFDDSSSNKLLVLAESNQAKSNQTPYEFISSGNAGIKWEDYEAYCRKFKDGDSSLLDSTQRSKKFAKMMKTDTSSKYDIGFLARNLNDTRYATIVFRDALEDYANNHLVEDKPMFKVVCINGSVTSFLRKNFDDSSYAKKDRDKNIHHAVDASIISIFSNETKTLFNQLTQFADYKLFKNTDGSWKKIDPKTGVVTEVTDENWKQIRVRNQVSEIAKVIEKYIQDSNIERKARYSRKIENKTNISLFNDTVYSAKKVGYEDQIKRKNLKTLDIHESAKENKNSKVKRQFVYRKLVNVSLLNNDKLADLFAEKEDILMYRANPWVINLAEQIFNEYTENKKIKSQNVFEKYMLDLTKEFPEKFSEFLVKSMLRNKTAIIYDDKKNIVHRIKRLKMLSSELKENKLSNVIIRSKNQSGTKLSYQDTINSLALMIMRSIDPTAKKQYIRVPLNTLNLHLGDHDFDLHNMDAYLKKPKFVKYLKANEIGDEYKPWRVLTSGTLLIHKKDKKLMYISSFQNLNDVIEIKNLIETEYKENDDSDSKKKKKANRFLMTLSTILNDYILLDAKDNFDILGLSKNRIDEILNSKLGLDKIVK

SEQ ID NO: 88 - protein, 1138 aa, Acidothermus cellulolyticus 11B
MGGSEVGTVPVTWRLGVDVGERSIGLAAVSYEEDKPKEILAAVSWIHDGGVGDERSGASRLALRGMARRARRLRRFRRARLRDLDMLLSELGWTPLPDKNVSPVDAWLARKRLAEEYVVDETERRRLLGYAVSHMARHRGWRNPWTTIKDLKNLPQPSDSWERTRESLEARYSVSLEPGTVGQWAGYLLQRAPGIRLNPTQQSAGRRAELSNATAFETRLRQEDVLWELRCIADVQGLPEDVVSNVIDAVFCQKRPSVPAERIGRDPLDPSQLRASRACLEFQEYRIVAAVANLRIRDGSGSRPLSLEERNAVIEALLAQTERSLTWSDIALEILKLPNESDLTSVPEEDGPSSLAYSQFAPFDETSARIAEFIAKNRRKIPTFAQWWQEQDRTSRSDLVAALADNSIAGEEEQELLVHLPDAELEALEGLALPSGRVAYSRLTLSGLTRVMRDDGVDVHNARKTCFGVDDNWRPPLPALHEATGHPVVDRNLAILRKFLSSATMRWGPPQSIVVELARGASESRERQAEEEAARRAHRKANDRIRAELRASGLSDPSPADLVRARLLELYDCHCMYCGAPISWENSELDHIVPRTDGGSNRHENLAITCGACNKEKGRRPFASWAETSNRVQLRDVIDRVQKLKYSGNMYWTRDEFSRYKKSVVARLKRRTSDPEVIQSIESTGYAAVALRDRLLSYGEKNGVAQVAVFRGGVTAEARRWLDISIERLFSRVAIFAQSTSTKRLDRRHHAVDAVVLTTLTPGVAKTLADARSRRVSAEFWRRPSDVNRHSTEEPQSPAYRQWKESCSGLGDLLISTAARDSIAVAAPLRLRPTGALHEETLRAFSEHTVGAAWKGAELRRIVEPEVYAAFLALTDPGGRFLKVSPSEDVLPADENRHIVLSDRVLGPRDRVKLFPDDRGSIRVRGGAAYIASFHHARVFRWGSSHSPSFALLRVSLADLAVAGLLRDGVDVFTAELPPWTPAWRYASIALVKAVESGDAKQVGWLVPGDELDFGPEGVTTAAGDLSMFLKYFPERHWVVTGFEDDKRINLKPAFLSAEQAEVLRTERSDRPDTLTEAGEILAQFFPRCWRATVAKVLCHPGLTVIRRTALGQPRWRRGHLPYSWRPWSADPWSGGTP

SEQ ID NO: 89 - protein, 1265 aa, Mycoplasma ovipneumoniae SC01
MHNKKNITIGFDLGIASIGWAIIDSTTSKILDWGTRTFEERKTANERRAFRSTRRNIRRKAYRNQRFINLILKYKDLFELKNISDIQRANKKDTENYEKIISFFTEIYKKCAAKHSNILEVKVKALDSKIEKLDLIWILHDYLENRGFFYDLEEENVADKYEGIEHPSILLYDFFKKNGFFKSNSSIPKDLGGYSFSNLQWVNEIKKLFEVQEINPEFSEKFLNLFTSVRDYAKGPGSEHSASEYGIFQKDEKGKVFKKYDNIWDKTIGKCSFFVEENRSPVNYPSYEIFNLLNQLINLSTDLKTTNKKIWQLSSNDRNELLDELLKVKEKAKIISISLKKNEIKKIILKDFGFEKSDIDDQDTIEGRKIIKEEPTTKLEVTKHLLATIYSHSSDSNWININNILEFLPYLDAICIILDREKSRGQDEVLKKLTEKNIFEVLKIDREKQLDFVKSIFSNTKFNFKKIGNFSLKAIREFLPKMFEQNKNSEYLKWKDEEIRRKWEEQKSKLGKTDKKTKYLNPRIFQDEIISPGTKNTFEQAVLVLNQIIKKYSKENIIDAIIIESPREKNDKKTIEEIKKRNKKGKGKTLEKLFQILNLENKGYKLSDLETKPAKLLDRLRFYHQQDGIDLYTLDKINIDQLINGSQKYEIEHIIPYSMSYDNSQANKILTEKAENLKKGKLIASEYIKRNGDEFYNKYYEKAKELFINKYKKNKKLDSYVDLDEDSAKNRFRFLTLQDYDEFQVEFLARNLNDTRYSTKLFYHALVEHFENNEFFTYIDENSSKHKVKISTIKGHVTKYFRAKPVQKNNGPNENLNNNKPEKIEKNRENNEHHAVDAAIVAIIGNKNPQIANLLTLADNKTDKKFLLHDENYKENIETGELVKIPKFEVDKLAKVEDLKKIIQEKYEEAKKHTAIKFSRKTRTILNGGLSDETLYGFKYDEKEDKYFKIIKKKLVTSKNEELKKYFENPFGKKADGKSEYTVLMAQSHLSEFNKLKEIFEKYNGFSNKTGNAFVEYMNDLALKEPTLKAEIESAKSVEKLLYYNFKPSDQFTYHDNINNKSFKRFYKNIRIIEYKSIPIKFKILSKHDGGKSFKDTLFSLYSLVYKVYENGKESYKSIPVTSQMRNFGIDEFDFLDENLYNKEKLDIYKSDFAKPIPVNCKPVFVLKKGSILKKKSLDIDDFKETKETEEGNYYFISTISKRFNRDTAYGLKPLKLSVVKPVAEPSTNPIFKEYIPIHLDELGNEYPVKIKEHTDDEKLMCTIK

SEQ ID NO: 90 - DNA, 5 bp, Streptococcus thermophilus A
  misc_feature (1)..(1): n is a, c, g, or t
  misc_feature (4)..(4): n is a, c, g, or t
nggng

SEQ ID NO: 91 - RNA, 96 nt, Artificial Sequence
  Synthetic
  misc_feature (1)..(20): n is a, c, g, or u
nnnnnnnnnnnnnnnnnnnnguuuaagagcuagaaauagcaaguuuaaauaaggcuaguccguuaucaacuugaaaaaguggcaccgagucggugc

SEQ ID NO: 92 - RNA, 116 nt, Artificial Sequence
  Synthetic
  misc_feature (1)..(20): n is a, c, g, or u
nnnnnnnnnnnnnnnnnnnnguauuagagcuaugcuguauuggaaacaauacagcauagcaaguuaauauaaggcuaguccguuaucaacuugaaaaaguggcaccgagucggugc

SEQ ID NO: 93 - DNA, 5 bp, Staphylococcus aureus
  misc_feature (1)..(2): n is a, c, g, or t
nngrr

SEQ ID NO: 94 - DNA, 8 bp, Neisseria meningitidis
  misc_feature (1)..(4): n is a, c, g, or t
nnnngatt

SEQ ID NO: 95 - DNA, 6 bp, Neisseria meningitidis
  misc_feature (1)..(2): n is a, c, g, or t
nngrrt

SEQ ID NO: 96 - DNA, 6 bp, Treponema denticola
  misc_feature (1)..(1): n is a, c, g, or t
  misc_feature (6)..(6): n is a, c, g, or t
naaaan

SEQ ID NO: 97 - DNA, 7 bp, Streptococcus thermophilus B
  misc_feature (1)..(2): n is a, c, g, or t
nnaaaaw

SEQ ID NO: 98 - DNA, 7 bp, Campylobacter jejuni
  misc_feature (1)..(4): n is a, c, g, or t
nnnnaca

SEQ ID NO: 99 - DNA, 8 bp, Pasteurella multocida
  misc_feature (2)..(4): n is a, c, g, or t
  misc_feature (6)..(7): n is a, c, g, or t
gnnncnna

SEQ ID NO: 100 - RNA, 47 nt, Artificial Sequence
  Synthetic
aaggcuaguccguuaucaacuugaaaaaguggcaccgagucggugcu

SEQ ID NO: 101 - RNA, 49 nt, Artificial Sequence
  Synthetic
aaggcuaguccguuaucaacuugaaaaaguggcaccgagucgguggugc

SEQ ID NO: 102 - RNA, 51 nt, Artificial Sequence
  Synthetic
aaggcuaguccguuaucaacuugaaaaaguggcaccgagucggugcggauc

SEQ ID NO: 103 - RNA, 31 nt, Artificial Sequence
  Synthetic
aaggcuaguccguuaucaacuugaaaaagug

SEQ ID NO: 104 - RNA, 18 nt, Artificial Sequence
  Synthetic
aaggcuaguccguuauca

SEQ ID NO: 105 - RNA, 12 nt, Artificial Sequence
  Synthetic
aaggcuaguccg

SEQ ID NO: 106 - RNA, 102 nt, Artificial Sequence
  Synthetic
  misc_feature (1)..(20): n is a, c, g, or u
nnnnnnnnnnnnnnnnnnnnguuuuagagcuagaaauagcaaguuaaaauaaggcuaguccguuaucaacuugaaaaaguggcaccgagucggugcuuuuuu

SEQ ID NO: 107 - RNA, 102 nt, Artificial Sequence
  Synthetic
  misc_feature (1)..(20): n is a, c, g, or u
nnnnnnnnnnnnnnnnnnnnguuuuaguacucuggaaacagaaucuacuaaaacaaggcaaaaugccguguuuaucucgucaacuuguuggcgagauuuuuu

SEQ ID NO: 108 - protein, 12 aa, Artificial Sequence
  Synthetic
  misc_feature (2)..(2): Xaa is selected from I, V, M, L and T
  misc_feature (4)..(4): Xaa is selected from  T, I, V, S, N, Y, E and L
  misc_feature (5)..(5): Xaa is selected from N, S, G, A, D, T, R, M and F
  misc_feature (6)..(6): Xaa is selected from S, Y, N and F
  misc_feature (7)..(7): Xaa is selected from V, I, L, C, T and F
  misc_feature (9)..(9): Xaa is selected from W, F, V, Y, S and L
  misc_feature (10)..(10): Xaa is selected from A, S, C, V and G
  misc_feature (11)..(11): Xaa is selected from V, I, L, A, M and H
  misc_feature (12)..(12): Xaa is selected from any amino acid or is absent
DXGXXXXGXXXX

SEQ ID NO: 109 - protein, 12 aa, Artificial Sequence
  Synthetic
  misc_feature (2)..(2): Xaa is selected from I, V, M, L and T
  misc_feature (4)..(4): Xaa is selected from  T, I, V, S, N, Y, E and L
  misc_feature (5)..(5): Xaa is selected from N, S, G, A, D, T, R, M and F
  misc_feature (7)..(7): Xaa is selected from V, I, L, C, T and F
  misc_feature (9)..(9): Xaa is selected from W, F, V, Y, S and L
  misc_feature (10)..(10): Xaa is selected from A, S, C, V and G
  misc_feature (11)..(11): Xaa is selected from V, I, L, A, M and H
  misc_feature (12)..(12): Xaa is selected from any amino acid or is absent
DXGXXSXGXXXX

SEQ ID NO: 110 - protein, 12 aa, Artificial Sequence
  Synthetic
  misc_feature (4)..(4): Xaa is selected from T, I, V, S, N, Y, E and L
  misc_feature (5)..(5): Xaa is selected from N, S, G, A, D, T, R, M and F
  misc_feature (11)..(11): Xaa is selected from V, I, L, A, M and H
  misc_feature (12)..(12): Xaa is selected from any amino acid or is absent
DIGXXSVGWAXX

SEQ ID NO: 111 - protein, 12 aa, Artificial Sequence
  Synthetic
  misc_feature (12)..(12): Xaa is a non-polar alkyl amino acid or a hydroxyl amino acid, e.g., X is selected from V, I, L and T
DIGTNSVGWAVX

SEQ ID NO: 112 - protein, 8 aa, Artificial Sequence
  Synthetic
  misc_feature (2)..(2): Xaa is V or H
  misc_feature (3)..(3): Xaa is I, L or V
  misc_feature (5)..(5): Xaa is M or T
IXXEXARE

SEQ ID NO: 113 - protein, 8 aa, Artificial Sequence
  Synthetic
  misc_feature (3)..(3): Xaa is I, L or V
IVXEMARE

SEQ ID NO: 114 - protein, 8 aa, Artificial Sequence
  Synthetic
  misc_feature (4)..(4): Xaa is H or L
  misc_feature (7)..(7): Xaa is R or V
  misc_feature (8)..(8): Xaa is E or V
HHAXDAXX

SEQ ID NO: 115 - protein, 8 aa, Artificial Sequence
  Synthetic
HHAHDAYL

SEQ ID NO: 116 - protein, 11 aa, Artificial Sequence
  Synthetic
  misc_feature (2)..(2): Xaa is selected from K and P
  misc_feature (4)..(4): Xaa is selected from V, L, I, and F
  misc_feature (5)..(5): Xaa is selected from G, A and S
  misc_feature (6)..(6): Xaa is selected from L, I, V and F
  misc_feature (7)..(7): Xaa is N-terminal RuvC-like domain
  misc_feature (10)..(10): Xaa is selected from D, E, N and Q
KXYXXXXTDXY

SEQ ID NO: 117 - protein, 27 aa, Artificial Sequence
  Synthetic
  misc_feature (1)..(1): Xaa is selected from D, E, Q and N
  misc_feature (2)..(2): Xaa is selected from L, I, R, Q, V, M and K
  misc_feature (3)..(3): Xaa is selected from D and E
  misc_feature (5)..(5): Xaa is selected from I, V, T, A and L
  misc_feature (6)..(6): Xaa is selected from V, Y, I, L, F and W
  misc_feature (8)..(8): Xaa is selected from Q, H, R, K, Y, I, L, F and W
  misc_feature (9)..(9): Xaa is selected from S, A, D, T and K
  misc_feature (10)..(10): Xaa is selected from F, L, V, K, Y, M, I, R, A, E, D and Q
  misc_feature (11)..(11): Xaa is selected from L, R, T, I, V, S, C, Y, K, F and G
  misc_feature (12)..(12): Xaa is selected from K, Q, Y, T, F, L, W, M, A, E, G, and S
  misc_feature (13)..(13): Xaa is selected from D, S, N, R, L and T
  misc_feature (14)..(14): Xaa is selected from D, N and S
  misc_feature (15)..(15): Xaa is selected from S, A, T, G and R
  misc_feature (16)..(16): Xaa is selected from I, L, F, S, R, Y, Q, W, D, K and H
  misc_feature (17)..(17): Xaa is selected from D, S, I, N, E, A, H, F, L, Q, M, G, Y and V
  misc_feature (19)..(19): Xaa is selected from K, L, R, M, T and F
  misc_feature (20)..(20): Xaa is selected from V, L, I, A and T
  misc_feature (21)..(21): Xaa is selected from L, I, V and A
  misc_feature (22)..(22): Xaa is selected from T, V, C, E, S and A
  misc_feature (23)..(23): Xaa is selected from R, F, T, W, E, L, N, C, K, V, S, Q, I, Y, H and A
  misc_feature (24)..(24): Xaa is selected from S, P, R, K, N, A, H, Q, G and L
  misc_feature (25)..(25): Xaa is selected from D, G, T, N, S, K, A, I, E, L, Q, R and Y
  misc_feature (26)..(26): Xaa is selected from K, V, A, E, Y, I, C, L, S, T, G, K, M, D and F
XXXHXXPXXXXXXXXXXNXXXXXXXXN

SEQ ID NO: 118 - protein, 27 aa, Artificial Sequence
  Synthetic
  misc_feature (1)..(1): Xaa is selected from D and E
  misc_feature (2)..(2): Xaa is selected from L, I, R, Q, V, M and K
  misc_feature (3)..(3): Xaa is selected from D and E
  misc_feature (5)..(5): Xaa is selected from I, V, T, A and L
  misc_feature (6)..(6): Xaa is selected from V, Y, I, L, F and W
  misc_feature (8)..(8): Xaa is selected from Q, H, R, K, Y, I, L, F and W
  misc_feature (10)..(10): Xaa is selected from F, L, V, K, Y, M, I, R, A, E, D and Q
  misc_feature (11)..(11): Xaa is selected from L, R, T, I, V, S, C, Y, K, F and G
  misc_feature (12)..(12): Xaa is selected from K, Q, Y, T, F, L, W, M, A, E, G, and S
  misc_feature (16)..(16): Xaa is selected from I, L, F, S, R, Y, Q, W, D, K and H
  misc_feature (17)..(17): Xaa is selected from D, S, I, N, E, A, H, F, L, Q, M, G, Y and V
  misc_feature (22)..(22): Xaa is selected from T, V, C, E, S and A
  misc_feature (23)..(23): Xaa is selected from R, F, T, W, E, L, N, C, K, V, S, Q, I, Y, H and A
  misc_feature (24)..(24): Xaa is selected from S, P, R, K, N, A, H, Q, G and L
  misc_feature (25)..(25): Xaa is selected from D, G, T, N, S, K, A, I, E, L, Q, R and Y
  misc_feature (26)..(26): Xaa is selected from K, V, A, E, Y, I, C, L, S, T, G, K, M, D and F
XXXHXXPXSXXXDDSXXNKVLXXXXXN

SEQ ID NO: 119 - protein, 27 aa, Artificial Sequence
  Synthetic
  misc_feature (1)..(1): Xaa is selected from D and E
  misc_feature (3)..(3): Xaa is selected from D and E
  misc_feature (8)..(8): Xaa is selected from Q, H, R, K, Y, I, L and W
  misc_feature (10)..(10): Xaa is selected from F, L, V, K, Y, M, I, R, A, E, D and Q
  misc_feature (11)..(11): Xaa is selected from L, R, T, I, V, S, C, Y, K, F and G
  misc_feature (12)..(12): Xaa is selected from K, Q, Y, T, F, L, W, M, A, E, G, and S
  misc_feature (16)..(16): Xaa is selected from I, L, F, S, R, Y, Q, W, D, K and H
  misc_feature (17)..(17): Xaa is selected from D, S, I, N, E, A, H, F, L, Q, M, G, Y and V
  misc_feature (23)..(23): Xaa is selected from R, F, T, W, E, L, N, C, K, V, S, Q, I, Y, H and A
  misc_feature (24)..(24): Xaa is selected from S, P, R, K, N, A, H, Q, G and L
  misc_feature (25)..(25): Xaa is selected from D, G, T, N, S, K, A, I, E, L, Q, R and Y
  misc_feature (26)..(26): Xaa is selected from K, V, A, E, Y, I, C, L, S, T, G, K, M, D and F
XVXHIVPXSXXXDDSXXNKVLTXXXXN

SEQ ID NO: 120 - protein, 27 aa, Artificial Sequence
  Synthetic
  misc_feature (2)..(2): Xaa is selected from I and V
  misc_feature (6)..(6): Xaa is selected from I and V
  misc_feature (9)..(9): Xaa is selected from A and S
  misc_feature (11)..(11): Xaa is selected from I and L
  misc_feature (12)..(12): Xaa is selected from K and T
  misc_feature (14)..(14): Xaa is selected from D and N
  misc_feature (19)..(19): Xaa is selected from R, K and L
  misc_feature (22)..(22): Xaa is selected from T and V
  misc_feature (23)..(23): Xaa is selected from S and R
  misc_feature (25)..(25): Xaa is selected from K, D and A
  misc_feature (26)..(26): Xaa is selected from E, K, G and N
DXDHIXPQXFXXDXSIDNXVLXXSXXN

SEQ ID NO: 121 - protein, 34 aa, Artificial Sequence
  Synthetic
  misc_feature (8)..(8): Xaa is selected from K and R
  misc_feature (12)..(12): Xaa is selected from V and T
  misc_feature (13)..(13): Xaa is selected from G and D
  misc_feature (14)..(14): Xaa is selected from E, Q and D
  misc_feature (15)..(15): Xaa is selected from E and D
  misc_feature (19)..(19): Xaa is selected from D, N and H
  misc_feature (20)..(20): Xaa is selected from Y, R and N
  misc_feature (23)..(23): Xaa is selected from Q, D and N
  misc_feature (28)..(28): Xaa is selected from G and E
  misc_feature (30)..(30): Xaa is selected from S and G
  misc_feature (32)..(32): Xaa is selected from D and N
LYYLQNGXDMYXXXXLDIXXLSXYZNRXKXDXVP

SEQ ID NO: 122 - DNA, 7 bp, Streptococcus thermophilus A
  misc_feature (1)..(2): n is a, c, g, or t
nnagaaw

SEQ ID NO: 123 - DNA, 4 bp, Staphylococcus aureus
  misc_feature (1)..(1): n is a, c, g, or t
naar

SEQ ID NO: 124 - DNA, 6 bp, Staphylococcus aureus
  misc_feature (1)..(2): n is a, c, g, or t
  misc_feature (6)..(6): n is a, c, g, or t
nngrrn

SEQ ID NO: 125 - DNA, 6 bp, Staphylococcus aureus
  misc_feature (1)..(2): n is a, c, g, or t
nngrrv

SEQ ID NO: 126 - DNA, 7 bp, Neisseria meningitidis
  misc_feature (1)..(3): n is a, c, g, or t
nnngctt

SEQ ID NO: 127 - protein, 20 aa, Artificial Sequence
  Synthetic
  misc_feature (5)..(20): "Gly-Ser-Gly-Ser" may or may not be present
GSGSGSGSGSGSGSGSGSGS

SEQ ID NO: 128 - protein, 4 aa, Artificial Sequence
  Synthetic
GSGS

SEQ ID NO: 129 - DNA, 4107 bp, S. pyogenes
atggataaaaagtacagcatcgggctggacatcggtacaaactcagtggggtgggccgtgattacggacgagtacaaggtaccctccaaaaaatttaaagtgctgggtaacacggacagacactctataaagaaaaatcttattggagccttgctgttcgactcaggcgagacagccgaagccacaaggttgaagcggaccgccaggaggcggtataccaggagaaagaaccgcatatgctacctgcaagaaatcttcagtaacgagatggcaaaggttgacgatagctttttccatcgcctggaagaatcctttcttgttgaggaagacaagaagcacgaacggcaccccatctttggcaatattgtcgacgaagtggcatatcacgaaaagtacccgactatctaccacctcaggaagaagctggtggactctaccgataaggcggacctcagacttatttatttggcactcgcccacatgattaaatttagaggacatttcttgatcgagggcgacctgaacccggacaacagtgacgtcgataagctgttcatccaacttgtgcagacctacaatcaactgttcgaagaaaaccctataaatgcttcaggagtcgacgctaaagcaatcctgtccgcgcgcctctcaaaatctagaagacttgagaatctgattgctcagttgcccggggaaaagaaaaatggattgtttggcaacctgatcgccctcagtctcggactgaccccaaatttcaaaagtaacttcgacctggccgaagacgctaagctccagctgtccaaggacacatacgatgacgacctcgacaatctgctggcccagattggggatcagtacgccgatctctttttggcagcaaagaacctgtccgacgccatcctgttgagcgatatcttgagagtgaacaccgaaattactaaagcaccccttagcgcatctatgatcaagcggtacgacgagcatcatcaggatctgaccctgctgaaggctcttgtgaggcaacagctccccgaaaaatacaaggaaatcttctttgaccagagcaaaaacggctacgctggctatatagatggtggggccagtcaggaggaattctataaattcatcaagcccattctcgagaaaatggacggcacagaggagttgctggtcaaacttaacagggaggacctgctgcggaagcagcggacctttgacaacgggtctatcccccaccagattcatctgggcgaactgcacgcaatcctgaggaggcaggaggatttttatccttttcttaaagataaccgcgagaaaatagaaaagattcttacattcaggatcccgtactacgtgggacctctcgcccggggcaattcacggtttgcctggatgacaaggaagtcagaggagactattacaccttggaacttcgaagaagtggtggacaagggtgcatctgcccagtctttcatcgagcggatgacaaattttgacaagaacctccctaatgagaaggtgctgcccaaacattctctgctctacgagtactttaccgtctacaatgaactgactaaagtcaagtacgtcaccgagggaatgaggaagccggcattccttagtggagaacagaagaaggcgattgtagacctgttgttcaagaccaacaggaaggtgactgtgaagcaacttaaagaagactactttaagaagatcgaatgttttgacagtgtggaaatttcaggggttgaagaccgcttcaatgcgtcattggggacttaccatgatcttctcaagatcataaaggacaaagacttcctggacaacgaagaaaatgaggatattctcgaagacatcgtcctcaccctgaccctgttcgaagacagggaaatgatagaagagcgcttgaaaacctatgcccacctcttcgacgataaagttatgaagcagctgaagcgcaggagatacacaggatggggaagattgtcaaggaagctgatcaatggaattagggataaacagagtggcaagaccatactggatttcctcaaatctgatggcttcgccaataggaacttcatgcaactgattcacgatgactctcttaccttcaaggaggacattcaaaaggctcaggtgagcgggcagggagactcccttcatgaacacatcgcgaatttggcaggttcccccgctattaaaaagggcatccttcaaactgtcaaggtggtggatgaattggtcaaggtaatgggcagacataagccagaaaatattgtgatcgagatggcccgcgaaaaccagaccacacagaagggccagaaaaatagtagagagcggatgaagaggatcgaggagggcatcaaagagctgggatctcagattctcaaagaacaccccgtagaaaacacacagctgcagaacgaaaaattgtacttgtactatctgcagaacggcagagacatgtacgtcgaccaagaacttgatattaatagactgtccgactatgacgtagaccatatcgtgccccagtccttcctgaaggacgactccattgataacaaagtcttgacaagaagcgacaagaacaggggtaaaagtgataatgtgcctagcgaggaggtggtgaaaaaaatgaagaactactggcgacagctgcttaatgcaaagctcattacacaacggaagttcgataatctgacgaaagcagagagaggtggcttgtctgagttggacaaggcagggtttattaagcggcagctggtggaaactaggcagatcacaaagcacgtggcgcagattttggacagccggatgaacacaaaatacgacgaaaatgataaactgatacgagaggtcaaagttatcacgctgaaaagcaagctggtgtccgattttcggaaagacttccagttctacaaagttcgcgagattaataactaccatcatgctcacgatgcgtacctgaacgctgttgtcgggaccgccttgataaagaagtacccaaagctggaatccgagttcgtatacggggattacaaagtgtacgatgtgaggaaaatgatagccaagtccgagcaggagattggaaaggccacagctaagtacttcttttattctaacatcatgaatttttttaagacggaaattaccctggccaacggagagatcagaaagcggccccttatagagacaaatggtgaaacaggtgaaatcgtctgggataagggcagggatttcgctactgtgaggaaggtgctgagtatgccacaggtaaatatcgtgaaaaaaaccgaagtacagaccggaggattttccaaggaaagcattttgcctaaaagaaactcagacaagctcatcgcccgcaagaaagattgggaccctaagaaatacgggggatttgactcacccaccgtagcctattctgtgctggtggtagctaaggtggaaaaaggaaagtctaagaagctgaagtccgtgaaggaactcttgggaatcactatcatggaaagatcatcctttgaaaagaaccctatcgatttcctggaggctaagggttacaaggaggtcaagaaagacctcatcattaaactgccaaaatactctctcttcgagctggaaaatggcaggaagagaatgttggccagcgccggagagctgcaaaagggaaacgagcttgctctgccctccaaatatgttaattttctctatctcgcttcccactatgaaaagctgaaagggtctcccgaagataacgagcagaagcagctgttcgtcgaacagcacaagcactatctggatgaaataatcgaacaaataagcgagttcagcaaaagggttatcctggcggatgctaatttggacaaagtactgtctgcttataacaagcaccgggataagcctattagggaacaagccgagaatataattcacctctttacactcacgaatctcggagcccccgccgccttcaaatactttgatacgactatcgaccggaaacggtataccagtaccaaagaggtcctcgatgccaccctcatccaccagtcaattactggcctgtacgaaacacggatcgacctctctcaactgggcggcgactag

SEQ ID NO: 130 - protein, 1368 aa, S. pyogenes [sequence omitted]

SEQ ID NO: 131 - DNA, 3249 bp, N. meningitidis
atggccgccttcaagcccaaccccatcaactacatcctgggcctggacatcggcatcgccagcgtgggctgggccatggtggagatcgacgaggacgagaaccccatctgcctgatcgacctgggtgtgcgcgtgttcgagcgcgctgaggtgcccaagactggtgacagtctggctatggctcgccggcttgctcgctctgttcggcgccttactcgccggcgcgctcaccgccttctgcgcgctcgccgcctgctgaagcgcgagggtgtgctgcaggctgccgacttcgacgagaacggcctgatcaagagcctgcccaacactccttggcagctgcgcgctgccgctctggaccgcaagctgactcctctggagtggagcgccgtgctgctgcacctgatcaagcaccgcggctacctgagccagcgcaagaacgagggcgagaccgccgacaaggagctgggtgctctgctgaagggcgtggccgacaacgcccacgccctgcagactggtgacttccgcactcctgctgagctggccctgaacaagttcgagaaggagagcggccacatccgcaaccagcgcggcgactacagccacaccttcagccgcaaggacctgcaggccgagctgatcctgctgttcgagaagcagaaggagttcggcaacccccacgtgagcggcggcctgaaggagggcatcgagaccctgctgatgacccagcgccccgccctgagcggcgacgccgtgcagaagatgctgggccactgcaccttcgagccagccgagcccaaggccgccaagaacacctacaccgccgagcgcttcatctggctgaccaagctgaacaacctgcgcatcctggagcagggcagcgagcgccccctgaccgacaccgagcgcgccaccctgatggacgagccctaccgcaagagcaagctgacctacgcccaggcccgcaagctgctgggtctggaggacaccgccttcttcaagggcctgcgctacggcaaggacaacgccgaggccagcaccctgatggagatgaaggcctaccacgccatcagccgcgccctggagaaggagggcctgaaggacaagaagagtcctctgaacctgagccccgagctgcaggacgagatcggcaccgccttcagcctgttcaagaccgacgaggacatcaccggccgcctgaaggaccgcatccagcccgagatcctggaggccctgctgaagcacatcagcttcgacaagttcgtgcagatcagcctgaaggccctgcgccgcatcgtgcccctgatggagcagggcaagcgctacgacgaggcctgcgccgagatctacggcgaccactacggcaagaagaacaccgaggagaagatctacctgcctcctatccccgccgacgagatccgcaaccccgtggtgctgcgcgccctgagccaggcccgcaaggtgatcaacggcgtggtgcgccgctacggcagccccgcccgcatccacatcgagaccgcccgcgaggtgggcaagagcttcaaggaccgcaaggagatcgagaagcgccaggaggagaaccgcaaggaccgcgagaaggccgccgccaagttccgcgagtacttccccaacttcgtgggcgagcccaagagcaaggacatcctgaagctgcgcctgtacgagcagcagcacggcaagtgcctgtacagcggcaaggagatcaacctgggccgcctgaacgagaagggctacgtggagatcgaccacgccctgcccttcagccgcacctgggacgacagcttcaacaacaaggtgctggtgctgggcagcgagaaccagaacaagggcaaccagaccccctacgagtacttcaacggcaaggacaacagccgcgagtggcaggagttcaaggcccgcgtggagaccagccgcttcccccgcagcaagaagcagcgcatcctgctgcagaagttcgacgaggacggcttcaaggagcgcaacctgaacgacacccgctacgtgaaccgcttcctgtgccagttcgtggccgaccgcatgcgcctgaccggcaagggcaagaagcgcgtgttcgccagcaacggccagatcaccaacctgctgcgcggcttctggggcctgcgcaaggtgcgcgccgagaacgaccgccaccacgccctggacgccgtggtggtggcctgcagcaccgtggccatgcagcagaagatcacccgcttcgtgcgctacaaggagatgaacgccttcgacggtaaaaccatcgacaaggagaccggcgaggtgctgcaccagaagacccacttcccccagccctgggagttcttcgcccaggaggtgatgatccgcgtgttcggcaagcccgacggcaagcccgagttcgaggaggccgacacccccgagaagctgcgcaccctgctggccgagaagctgagcagccgccctgaggccgtgcacgagtacgtgactcctctgttcgtgagccgcgcccccaaccgcaagatgagcggtcagggtcacatggagaccgtgaagagcgccaagcgcctggacgagggcgtgagcgtgctgcgcgtgcccctgacccagctgaagctgaaggacctggagaagatggtgaaccgcgagcgcgagcccaagctgtacgaggccctgaaggcccgcctggaggcccacaaggacgaccccgccaaggccttcgccgagcccttctacaagtacgacaaggccggcaaccgcacccagcaggtgaaggccgtgcgcgtggagcaggtgcagaagaccggcgtgtgggtgcgcaaccacaacggcatcgccgacaacgccaccatggtgcgcgtggacgtgttcgagaagggcgacaagtactacctggtgcccatctacagctggcaggtggccaagggcatcctgcccgaccgcgccgtggtgcagggcaaggacgaggaggactggcagctgatcgacgacagcttcaacttcaagttcagcctgcaccccaacgacctggtggaggtgatcaccaagaaggcccgcatgttcggctacttcgccagctgccaccgcggcaccggcaacatcaacatccgcatccacgacctggaccacaagatcggcaagaacggcatcctggagggcatcggcgtgaagaccgccctgagcttccagaagtaccagatcgacgagctgggcaaggagatccgcccctgccgcctgaagaagcgccctcctgtgcgctaa

SEQ ID NO: 132 - protein, 1082 aa, N. meningitidis; identical to SEQ ID NO: 63

SEQ ID NO: 133 - protein, 1053 aa, S. aureus; identical to SEQ ID NO: 6

SEQ ID NO: 134 - DNA, 3159 bp, S. aureus
atgaaaaggaactacattctggggctggacatcgggattacaagcgtggggtatgggattattgactatgaaacaagggacgtgatcgacgcaggcgtcagactgttcaaggaggccaacgtggaaaacaatgagggacggagaagcaagaggggagccaggcgcctgaaacgacggagaaggcacagaatccagagggtgaagaaactgctgttcgattacaacctgctgaccgaccattctgagctgagtggaattaatccttatgaagccagggtgaaaggcctgagtcagaagctgtcagaggaagagttttccgcagctctgctgcacctggctaagcgccgaggagtgcataacgtcaatgaggtggaagaggacaccggcaacgagctgtctacaaaggaacagatctcacgcaatagcaaagctctggaagagaagtatgtcgcagagctgcagctggaacggctgaagaaagatggcgaggtgagagggtcaattaataggttcaagacaagcgactacgtcaaagaagccaagcagctgctgaaagtgcagaaggcttaccaccagctggatcagagcttcatcgatacttatatcgacctgctggagactcggagaacctactatgagggaccaggagaagggagccccttcggatggaaagacatcaaggaatggtacgagatgctgatgggacattgcacctattttccagaagagctgagaagcgtcaagtacgcttataacgcagatctgtacaacgccctgaatgacctgaacaacctggtcatcaccagggatgaaaacgagaaactggaatactatgagaagttccagatcatcgaaaacgtgtttaagcagaagaaaaagcctacactgaaacagattgctaaggagatcctggtcaacgaagaggacatcaagggctaccgggtgacaagcactggaaaaccagagttcaccaatctgaaagtgtatcacgatattaaggacatcacagcacggaaagaaatcattgagaacgccgaactgctggatcagattgctaagatcctgactatctaccagagctccgaggacatccaggaagagctgactaacctgaacagcgagctgacccaggaagagatcgaacagattagtaatctgaaggggtacaccggaacacacaacctgtccctgaaagctatcaatctgattctggatgagctgtggcatacaaacgacaatcagattgcaatctttaaccggctgaagctggtcccaaaaaaggtggacctgagtcagcagaaagagatcccaaccacactggtggacgatttcattctgtcacccgtggtcaagcggagcttcatccagagcatcaaagtgatcaacgccatcatcaagaagtacggcctgcccaatgatatcattatcgagctggctagggagaagaacagcaaggacgcacagaagatgatcaatgagatgcagaaacgaaaccggcagaccaatgaacgcattgaagagattatccgaactaccgggaaagagaacgcaaagtacctgattgaaaaaatcaagctgcacgatatgcaggagggaaagtgtctgtattctctggaggccatccccctggaggacctgctgaacaatccattcaactacgaggtcgatcatattatccccagaagcgtgtccttcgacaattcctttaacaacaaggtgctggtcaagcaggaagagaactctaaaaagggcaataggactcctttccagtacctgtctagttcagattccaagatctcttacgaaacctttaaaaagcacattctgaatctggccaaaggaaagggccgcatcagcaagaccaaaaaggagtacctgctggaagagcgggacatcaacagattctccgtccagaaggattttattaaccggaatctggtggacacaagatacgctactcgcggcctgatgaatctgctgcgatcctatttccgggtgaacaatctggatgtgaaagtcaagtccatcaacggcgggttcacatcttttctgaggcgcaaatggaagtttaaaaaggagcgcaacaaagggtacaagcaccatgccgaagatgctctgattatcgcaaatgccgacttcatctttaaggagtggaaaaagctggacaaagccaagaaagtgatggagaaccagatgttcgaagagaagcaggccgaatctatgcccgaaatcgagacagaacaggagtacaaggagattttcatcactcctcaccagatcaagcatatcaaggatttcaaggactacaagtactctcaccgggtggataaaaagcccaacagagagctgatcaatgacaccctgtatagtacaagaaaagacgataaggggaataccctgattgtgaacaatctgaacggactgtacgacaaagataatgacaagctgaaaaagctgatcaacaaaagtcccgagaagctgctgatgtaccaccatgatcctcagacatatcagaaactgaagctgattatggagcagtacggcgacgagaagaacccactgtataagtactatgaagagactgggaactacctgaccaagtatagcaaaaaggataatggccccgtgatcaagaagatcaagtactatgggaacaagctgaatgcccatctggacatcacagacgattaccctaacagtcgcaacaaggtggtcaagctgtcactgaagccatacagattcgatgtctatctggacaacggcgtgtataaatttgtgactgtcaagaatctggatgtcatcaaaaaggagaactactatgaagtgaatagcaagtgctacgaagaggctaaaaagctgaaaaagattagcaaccaggcagagttcatcgcctccttttacaacaacgacctgattaagatcaatggcgaactgtatagggtcatcggggtgaacaatgatctgctgaaccgcattgaagtgaatatgattgacatcacttaccgagagtatctggaaaacatgaatgataagcgcccccctcgaattatcaaaacaattgcctctaagactcagagtatcaaaaagtactcaaccgacattctgggaaacctgtatgaggtgaagagcaaaaagcaccctcagattatcaaaaagggc

SEQ ID NO: 135 - protein, 12 aa, Artificial Sequence
  Synthetic
SGSETPGTSESA

SEQ ID NO: 136 - protein, 16 aa, Artificial Sequence
  Synthetic
SGSETPGTSESATPES

SEQ ID NO: 137 - protein, 21 aa, Artificial Sequence
  Synthetic
SGSETPGTSESATPEGGSGGS

SEQ ID NO: 138 - protein, 4 aa, Artificial Sequence
  Synthetic
GSGS

SEQ ID NO: 139 - protein, 4 aa, Artificial Sequence
  Synthetic
GGGS

SEQ ID NO: 140 - protein, 5 aa, Artificial Sequence
  Synthetic
GGGGS

SEQ ID NO: 141 - protein, 4 aa, Artificial Sequence
  Synthetic
GGSG

SEQ ID NO: 142 - protein, 6 aa, Artificial Sequence
  Synthetic
GSGSGS

SEQ ID NO: 143 - protein, 10 aa, Artificial Sequence
  Synthetic
GSGSGSGSGS

SEQ ID NO: 144 - protein, 8 aa, Artificial Sequence
  Synthetic
GGSGGGSG

SEQ ID NO: 145 - protein, 12 aa, Artificial Sequence
  Synthetic
GGSGGGSGGGSG

SEQ ID NO: 146 - protein, 15 aa, Artificial Sequence
  Synthetic
GGGGSGGGGSGGGGS

SEQ ID NO: 147 - protein, 6 aa, Artificial Sequence
  Synthetic
GGSGGS

SEQ ID NO: 148 - protein, 1014 aa, Homo sapiens
MAESSDKLYRVEYAKSGRASCKKCSESIPKDSLRMAIMVQSPMFDGKVPHWYHFSCFWKVGHSIRHPDVEVDGFSELRWDDQQKVKKTAEAGGVTGKGQDGIGSKAEKTLGDFAAEYAKSNRSTCKGCMEKIEKGQVRLSKKMVDPEKPQLGMIDRWYHPGCFVKNREELGFRPEYSASQLKGFSLLATEDKEALKKQLPGVKSEGKRKGDEVDGVDEVAKKKSKKEKDKDSKLEKALKAQNDLIWNIKDELKKVCSTNDLKELLIFNKQQVPSGESAILDRVADGMVFGALLPCEECSGQLVFKSDAYYCTGDVTAWTKCMVKTQTPNRKEWVTPKEFREISYLKKLKVKKQDRIFPPETSASVAATPPPSTASAPAAVNSSASADKPLSNMKILTLGKLSRNKDEVKAMIEKLGGKLTGTANKASLCISTKKEVEKMNKKMEEVKEANIRVVSEDFLQDVSASTKSLQELFLAHILSPWGAEVKAEPVEVVAPRGKSGAALSKKSKGQVKEEGINKSEKRMKLTLKGGAAVDPDSGLEHSAHVLEKGGKVFSATLGLVDIVKGTNSYYKLQLLEDDKENRYWIFRSWGRVGTVIGSNKLEQMPSKEDAIEHFMKLYEEKTGNAWHSKNFTKYPKKFYPLEIDYGQDEEAVKKLTVNPGTKSKLPKPVQDLIKMIFDVESMKKAMVEYEIDLQKMPLGKLSKRQIQAAYSILSEVQQAVSQGSSDSQILDLSNRFYTLIPHDFGMKKPPLLNNADSVQAKVEMLDNLLDIEVAYSLLRGGSDDSSKDPIDVNYEKLKTDIKVVDRDSEEAEIIRKYVKNTHATTHNAYDLEVIDIFKIEREGECQRYKPFKQLHNRRLLWHGSRTTNFAGILSQGLRIAPPEAPVTGYMFGKGIYFADMVSKSANYCHTSQGDPIGLILLGEVALGNMYELKHASHISKLPKGKHSVKGLGKTTPDPSANISLDGVDVPLGTGISSGVNDTSLLYNEYIVYDIAQVNLKYLLKLKFNFKTSLW

SEQ ID NO: 149 - protein, 583 aa, Homo sapiens
MAARRRRSTGGGRARALNESKRVNNGNTAPEDSSPAKKTRRCQRQESKKMPVAGGKANKDRTEDKQDGMPGRSWASKRVSESVKALLLKGKAPVDPECTAKVGKAHVYCEGNDVYDVMLNQTNLQFNNNKYYLIQLLEDDAQRNFSVWMRWGRVGKMGQHSLVACSGNLNKAKEIFQKKFLDKTKNNWEDREKFEKVPGKYDMLQMDYATNTQDEEETKKEESLKSPLKPESQLDLRVQELIKLICNVQAMEEMMMEMKYNTKKAPLGKLTVAQIKAGYQSLKKIEDCIRAGQHGRALMEACNEFYTRIPHDFGLRTPPLIRTQKELSEKIQLLEALGDIEIAIKLVKTELQSPEHPLDQHYRNLHCALRPLDHESYEFKVISQYLQSTHAPTHSDYTMTLLDLFEVEKDGEKEAFREDLHNRMLLWHGSRMSNWVGILSHGLRIAPPEAPITGYMFGKGIYFADMSSKSANYCFASRLKNTGLLLLSEVALGQCNELLEANPKAEGLLQGKHSTKGLGKMAPSSAHFVTLNGSTVPLGPASDTGILNPDGYTLNYNEYIVYNPNQVRMRYLLKVQFNFLQLW

SEQ ID NO: 150 - protein, 570 aa, Homo sapiens
MAARRRRSTGGGRARALNESKRVNNGNTAPEDSSPAKKTRRCQRQESKKMPVAGGKANKDRTEDKQDESVKALLLKGKAPVDPECTAKVGKAHVYCEGNDVYDVMLNQTNLQFNNNKYYLIQLLEDDAQRNFSVWMRWGRVGKMGQHSLVACSGNLNKAKEIFQKKFLDKTKNNWEDREKFEKVPGKYDMLQMDYATNTQDEEETKKEESLKSPLKPESQLDLRVQELIKLICNVQAMEEMMMEMKYNTKKAPLGKLTVAQIKAGYQSLKKIEDCIRAGQHGRALMEACNEFYTRIPHDFGLRTPPLIRTQKELSEKIQLLEALGDIEIAIKLVKTELQSPEHPLDQHYRNLHCALRPLDHESYEFKVISQYLQSTHAPTHSDYTMTLLDLFEVEKDGEKEAFREDLHNRMLLWHGSRMSNWVGILSHGLRIAPPEAPITGYMFGKGIYFADMSSKSANYCFASRLKNTGLLLLSEVALGQCNELLEANPKAEGLLQGKHSTKGLGKMAPSSAHFVTLNGSTVPLGPASDTGILNPDGYTLNYNEYIVYNPNQVRMRYLLKVQFNFLQLW

SEQ ID NO: 151 - protein, 680 aa, Artificial Sequence
  Synthetic
MSTADALDDENTFKILVATDIHLGFMEKDAVRGNDTFVTLDEILRLAQENEVDFILLGGDLFHENKPSRKTLHTCLELLRKYCMGDRPVQFEILSDQSVNFGFSKFPWVNYQDGNLNISIPVFSIHGNHDDPTGADALCALDILSCAGFVNHFGRSMSVEKIDISPVLLQKGSTKIALYGLGSIPDERLYRMFVNKKVTMLRPKEDENSWFNLFVIHQNRSKHGSTNFIPEQFLDDFIDLVIWGHEHECKIAPTKNEQQLFYISQPGSSVVTSLSPGEAVKKHVGLLRIKGRKMNMHKIPLHTVRQFFMEDIVLANHPDIFNPDNPKVTQAIQSFCLEKIEEMLENAERERLGNSHQPEKPLVRLRVDYSGGFEPFSVLRFSQKFVDRVANPKDIIHFFRHREQKEKTGEEINFGKLITKPSEGTTLRVEDLVKQYFQTAEKNVQLSLLTERGMGEAVQEFVDKEEKDAIEELVKYQLEKTQRFLKERHIDALEDKIDEEVRRFRETRQKNTNEEDDEVREAMTRARALRSQSEESASAFSADDLMSIDLAEQMANDSDDSISAATNKGRGRGRGRRGGRGQNSASRGGSQRGRAFKSTRQQPSRNVTTKNYSEVIEVDESDVEEDIFPTTSKTDQRWSSTSSSKIMSQSQVSKGVDFESSEDDDDDPFMNTSSLRRNRR

SEQ ID NO: 152 - protein, 708 aa, Artificial Sequence
  Synthetic
MSTADALDDENTFKILVATDIHLGFMEKDAVRGNDTFVTLDEILRLAQENEVDFILLGGDLFHENKPSRKTLHTCLELLRKYCMGDRPVQFEILSDQSVNFGFSKFPWVNYQDGNLNISIPVFSIHGNHDDPTGADALCALDILSCAGFVNHFGRSMSVEKIDISPVLLQKGSTKIALYGLGSIPDERLYRMFVNKKVTMLRPKEDENSWFNLFVIHQNRSKHGSTNFIPEQFLDDFIDLVIWGHEHECKIAPTKNEQQLFYISQPGSSVVTSLSPGEAVKKHVGLLRIKGRKMNMHKIPLHTVRQFFMEDIVLANHPDIFNPDNPKVTQAIQSFCLEKIEEMLENAERERLGNSHQPEKPLVRLRVDYSGGFEPFSVLRFSQKFVDRVANPKDIIHFFRHREQKEKTGEEINFGKLITKPSEGTTLRVEDLVKQYFQTAEKNVQLSLLTERGMGEAVQEFVDKEEKDAIEELVKYQLEKTQRFLKERHIDALEDKIDEEVRRFRETRQKNTNEEDDEVREAMTRARALRSQSEESASAFSADDLMSIDLAEQMANDSDDSISAATNKGRGRGRGRRGGRGQNSASRGGSQRGRADTGLETSTRSRNSKTAVSASRNMSIIDAFKSTRQQPSRNVTTKNYSEVIEVDESDVEEDIFPTTSKTDQRWSSTSSSKIMSQSQVSKGVDFESSEDDDDDPFMNTSSLRRNRR

SEQ ID NO: 153 - protein, 1312 aa, Homo sapiens
MSRIEKMSILGVRSFGIEDKDKQIITFFSPLTILVGPNGAGKTTIIECLKYICTGDFPPGTKGNTFVHDPKVAQETDVRAQIRLQFRDVNGELIAVQRSMVCTQKSKKTEFKTLEGVITRTKHGEKVSLSSKCAEIDREMISSLGVSKAVLNNVIFCHQEDSNWPLSEGKALKQKFDEIFSATRYIKALETLRQVRQTQGQKVKEYQMELKYLKQYKEKACEIRDQITSKEAQLTSSKEIVKSYENELDPLKNRLKEIEHNLSKIMKLDNEIKALDSRKKQMEKDNSELEEKMEKVFQGTDEQLNDLYHNHQRTVREKERKLVDCHRELEKLNKESRLLNQEKSELLVEQGRLQLQADRHQEHIRARDSLIQSLATQLELDGFERGPFSERQIKNFHKLVRERQEGEAKTANQLMNDFAEKETLKQKQIDEIRDKKTGLGRIIELKSEILSKKQNELKNVKYELQQLEGSSDRILELDQELIKAERELSKAEKNSNVETLKMEVISLQNEKADLDRTLRKLDQEMEQLNHHTTTRTQMEMLTKDKADKDEQIRKIKSRHSDELTSLLGYFPNKKQLEDWLHSKSKEINQTRDRLAKLNKELASSEQNKNHINNELKRKEEQLSSYEDKLFDVCGSQDFESDLDRLKEEIEKSSKQRAMLAGATAVYSQFITQLTDENQSCCPVCQRVFQTEAELQEVISDLQSKLRLAPDKLKSTESELKKKEKRRDEMLGLVPMRQSIIDLKEKEIPELRNKLQNVNRDIQRLKNDIEEQETLLGTIMPEEESAKVCLTDVTIMERFQMELKDVERKIAQQAAKLQGIDLDRTVQQVNQEKQEKQHKLDTVSSKIELNRKLIQDQQEQIQHLKSTTNELKSEKLQISTNLQRRQQLEEQTVELSTEVQSLYREIKDAKEQVSPLETTLEKFQQEKEELINKKNTSNKIAQDKLNDIKEKVKNIHGYMKDIENYIQDGKDDYKKQKETELNKVIAQLSECEKHKEKINEDMRLMRQDIDTQKIQERWLQDNLTLRKRNEELKEVEEERKQHLKEMGQMQVLQMKSEHQKLEENIDNIKRNHNLALGRQKGYEEEIIHFKKELREPQFRDAEEKYREMMIVMRTTELVNKDLDIYYKTLDQAIMKFHSMKMEEINKIIRDLWRSTYRGQDIEYIEIRSDADENVSASDKRRNYNYRVVMLKGDTALDMRGRCSAGQKVLASLIIRLALAETFCLNCGIIALDEPTTNLDRENIESLAHALVEIIKSRSQQRNFQLLVITHDEDFVELLGRSEYVEKFYRIKKNIDQCSEIVKCSVSSLGFNVH

SEQ ID NO: 154 - protein, 754 aa, Homo sapiens
MWKLLPAAGPAGGEPYRLLTGVEYVVGRKNCAILIENDQSISRNHAVLTANFSVTNLSQTDEIPVLTLKDNSKYGTFVNEEKMQNGFSRTLKSGDGITFGVFGSKFRIEYEPLVACSSCLDVSGKTALNQAILQLGGFTVNNWTEECTHLVMVSVKVTIKTICALICGRPIVKPEYFTEFLKAVESKKQPPQIESFYPPLDEPSIGSKNVDLSGRQERKQIFKGKTFIFLNAKQHKKLSSAVVFGGGEARLITEENEEEHNFFLAPGTCVVDTGITNSQTLIPDCQKKWIQSIMDMLQRQGLRPIPEAEIGLAVIFMTTKNYCDPQGHPSTGLKTTTPGPSLSQGVSVDEKLMPSAPVNTTTYVADTESEQADTWDLSERPKEIKVSKMEQKFRMLSQDAPTVKESCKTSSNNNSMVSNTLAKMRIPNYQLSPTKLPSINKSKDRASQQQQTNSIRNYFQPSTKKRERDEENQEMSSCKSARIETSCSLLEQTQPATPSLWKNKEQHLSENEPVDTNSDNNLFTDTDLKSIVKNSASKSHAAEKLRSNKKREMDDVAIEDEVLEQLFKDTKPELEIDVKVQKQEEDVNVRKRPRMDIETNDTFSDEAVPESSKISQENEIGKKRELKEDSLWSAKEISNNDKLQDDSEMLPKKLLLTEFRSLVIKNSTSRNPSGINDDYGQLKNFKKFKKVTYPGAGKLPHIIGGSDLIAHHARKNTELEEWLRQEMEVQNQHAKEESLADDLFRYNPYLKRRR

SEQ ID NO: 155 - protein, 777 aa, Homo sapiens
MPDNRQPRNRQPRIRSGNEPRSAPAMEPDGRGAWAHSRAALDRLEKLLRCSRCTNILREPVCLGGCEHIFCSNCVSDCIGTGCPVCYTPAWIQDLKINRQLDSMIQLCSKLRNLLHDNELSDLKEDKPRKSLFNDAGNKKNSIKMWFSPRSKKVRYVVSKASVQTQPAIKKDASAQQDSYEFVSPSPPADVSERAKKASARSGKKQKKKTLAEINQKWNLEAEKEDGEFDSKEESKQKLVSFCSQPSVISSPQINGEIDLLASGSLTESECFGSLTEVSLPLAEQIESPDTKSRNEVVTPEKVCKNYLTSKKSLPLENNGKRGHHNRLSSPISKRCRTSILSTSGDFVKQTVPSENIPLPECSSPPSCKRKVGGTSGRKNSNMSDEFISLSPGTPPSTLSSSSYRRVMSSPSAMKLLPNMAVKRNHRGETLLHIASIKGDIPSVEYLLQNGSDPNVKDHAGWTPLHEACNHGHLKVVELLLQHKALVNTTGYQNDSPLHDAAKNGHVDIVKLLLSYGASRNAVNIFGLRPVDYTDDESMKSLLLLPEKNESSSASHCSVMNTGQRRDGPLVLIGSGLSSEQQKMLSELAVILKAKKYTEFDSTVTHVVVPGDAVQSTLKCMLGILNGCWILKFEWVKACLRRKVCEQEEKYEIPEGPRRSRLNREQLLPKLFDGCYFYLWGTFKHHPKDNLIKLVTAGGGQILSRKPKPDSDVTQTINTVAYHARPDSDQRFCTQYIIYEDLCNYHPERVRQGKVWKAPSSWFIDCVMSFELLPLDS

SEQ ID NO: 156 - protein, 758 aa, Homo sapiens
MPDNRQPRNRQPRIRSGNEPRSAPAMEPDGRGAWAHSRAALDRLEKLLRCSRCNCVSDCIGTGCPVCYTPAWIQDLKINRQLDSMIQLCSKLRNLLHDNELSDLKEDKPRKSLFNDAGNKKNSIKMWFSPRSKKVRYVVSKASVQTQPAIKKDASAQQDSYEFVSPSPPADVSERAKKASARSGKKQKKKTLAEINQKWNLEAEKEDGEFDSKEESKQKLVSFCSQPSVISSPQINGEIDLLASGSLTESECFGSLTEVSLPLAEQIESPDTKSRNEVVTPEKVCKNYLTSKKSLPLENNGKRGHHNRLSSPISKRCRTSILSTSGDFVKQTVPSENIPLPECSSPPSCKRKVGGTSGRKNSNMSDEFISLSPGTPPSTLSSSSYRRVMSSPSAMKLLPNMAVKRNHRGETLLHIASIKGDIPSVEYLLQNGSDPNVKDHAGWTPLHEACNHGHLKVVELLLQHKALVNTTGYQNDSPLHDAAKNGHVDIVKLLLSYGASRNAVNIFGLRPVDYTDDESMKSLLLLPEKNESSSASHCSVMNTGQRRDGPLVLIGSGLSSEQQKMLSELAVILKAKKYTEFDSTVTHVVVPGDAVQSTLKCMLGILNGCWILKFEWVKACLRRKVCEQEEKYEIPEGPRRSRLNREQLLPKLFDGCYFYLWGTFKHHPKDNLIKLVTAGGGQILSRKPKPDSDVTQTINTVAYHARPDSDQRFCTQYIIYEDLCNYHPERVRQGKVWKAPSSWFIDCVMSFELLPLDS

SEQ ID NO: 157 - protein, 326 aa, Homo sapiens
MPDNRQPRNRQPRIRSGNEPRSAPAMEPDGRGAWAHSRAALDRLEKLLRCSRCTNILREPVCLGGCEHIFCSNIFGLRPVDYTDDESMKSLLLLPEKNESSSASHCSVMNTGQRRDGPLVLIGSGLSSEQQKMLSELAVILKAKKYTEFDSTVTHVVVPGDAVQSTLKCMLGILNGCWILKFEWVKACLRRKVCEQEEKYEIPEGPRRSRLNREQLLPKLFDGCYFYLWGTFKHHPKDNLIKLVTAGGGQILSRKPKPDSDVTQTINTVAYHARPDSDQRFCTQYIIYEDLCNYHPERVRQGKVWKAPSSWFIDCVMSFELLPLDS

SEQ ID NO: 158 - protein, 307 aa, Homo sapiens
MPDNRQPRNRQPRIRSGNEPRSAPAMEPDGRGAWAHSRAALDRLEKLLRCSRCNIFGLRPVDYTDDESMKSLLLLPEKNESSSASHCSVMNTGQRRDGPLVLIGSGLSSEQQKMLSELAVILKAKKYTEFDSTVTHVVVPGDAVQSTLKCMLGILNGCWILKFEWVKACLRRKVCEQEEKYEIPEGPRRSRLNREQLLPKLFDGCYFYLWGTFKHHPKDNLIKLVTAGGGQILSRKPKPDSDVTQTINTVAYHARPDSDQRFCTQYIIYEDLCNYHPERVRQGKVWKAPSSWFIDCVMSFELLPLDS

SEQ ID NO: 159 - protein, 264 aa, Homo sapiens
MPDNRQPRNRQPRIRSGNEPRSAPAMEPDGRGAWAHSRAALDRLEKLLRCSRCTNILREPVCLGGCEHIFCSNCVSDCIGTGCPVCYTPAWIQDLKINRQLDSMIQLCSKLRNLLHDNELSGVKACLRRKVCEQEEKYEIPEGPRRSRLNREQLLPKLFDGCYFYLWGTFKHHPKDNLIKLVTAGGGQILSRKPKPDSDVTQTINTVAYHARPDSDQRFCTQYIIYEDLCNYHPERVRQGKVWKAPSSWFIDCVMSFELLPLDS

SEQ ID NO: 160 - protein, 3418 aa, Homo sapiens [sequence omitted]

SEQ ID NO: 161 - protein, 1863 aa, Homo sapiens
MDLSALRVEEVQNVINAMQKILECPICLELIKEPVSTKCDHIFCKFCMLKLLNQKKGPSQCPLCKNDITKRSLQESTRFSQLVEELLKIICAFQLDTGLEYANSYNFAKKENNSPEHLKDEVSIIQSMGYRNRAKRLLQSEPENPSLQETSLSVQLSNLGTVRTLRTKQRIQPQKTSVYIELGSDSSEDTVNKATYCSVGDQELLQITPQGTRDEISLDSAKKAACEFSETDVTNTEHHQPSNNDLNTTEKRAAERHPEKYQGSSVSNLHVEPCGTNTHASSLQHENSSLLLTKDRMNVEKAEFCNKSKQPGLARSQHNRWAGSKETCNDRRTPSTEKKVDLNADPLCERKEWNKQKLPCSENPRDTEDVPWITLNSSIQKVNEWFSRSDELLGSDDSHDGESESNAKVADVLDVLNEVDEYSGSSEKIDLLASDPHEALICKSERVHSKSVESNIEDKIFGKTYRKKASLPNLSHVTENLIIGAFVTEPQIIQERPLTNKLKRKRRPTSGLHPEDFIKKADLAVQKTPEMINQGTNQTEQNGQVMNITNSGHENKTKGDSIQNEKNPNPIESLEKESAFKTKAEPISSSISNMELELNIHNSKAPKKNRLRRKSSTRHIHALELVVSRNLSPPNCTELQIDSCSSSEEIKKKKYNQMPVRHSRNLQLMEGKEPATGAKKSNKPNEQTSKRHDSDTFPELKLTNAPGSFTKCSNTSELKEFVNPSLPREEKEEKLETVKVSNNAEDPKDLMLSGERVLQTERSVESSSISLVPGTDYGTQESISLLEVSTLGKAKTEPNKCVSQCAAFENPKGLIHGCSKDNRNDTEGFKYPLGHEVNHSRETSIEMEESELDAQYLQNTFKVSKRQSFAPFSNPGNAEEECATFSAHSGSLKKQSPKVTFECEQKEENQGKNESNIKPVQTVNITAGFPVVGQKDKPVDNAKCSIKGGSRFCLSSQFRGNETGLITPNKHGLLQNPYRIPPLFPIKSFVKTKCKKNLLEENFEEHSMSPEREMGNENIPSTVSTISRNNIRENVFKEASSSNINEVGSSTNEVGSSINEIGSSDENIQAELGRNRGPKLNAMLRLGVLQPEVYKQSLPGSNCKHPEIKKQEYEEVVQTVNTDFSPYLISDNLEQPMGSSHASQVCSETPDDLLDDGEIKEDTSFAENDIKESSAVFSKSVQKGELSRSPSPFTHTHLAQGYRRGAKKLESSEENLSSEDEELPCFQHLLFGKVNNIPSQSTRHSTVATECLSKNTEENLLSLKNSLNDCSNQVILAKASQEHHLSEETKCSASLFSSQCSELEDLTANTNTQDPFLIGSSKQMRHQSESQGVGLSDKELVSDDEERGTGLEENNQEEQSMDSNLGEAASGCESETSVSEDCSGLSSQSDILTTQQRDTMQHNLIKLQQEMAELEAVLEQHGSQPSNSYPSIISDSSALEDLRNPEQSTSEKAVLTSQKSSEYPISQNPEGLSADKFEVSADSSTSKNKEPGVERSSPSKCPSLDDRWYMHSCSGSLQNRNYPSQEELIKVVDVEEQQLEESGPHDLTETSYLPRQDLEGTPYLESGISLFSDDPESDPSEDRAPESARVGNIPSSTSALKVPQLKVAESAQSPAAAHTTDTAGYNAMEESVSREKPELTASTERVNKRMSMVVSGLTPEEFMLVYKFARKHHITLTNLITEETTHVVMKTDAEFVCERTLKYFLGIAGGKWVVSYFWVTQSIKERKMLNEHDFEVRGDVVNGRNHQGPKRARESQDRKIFRGLEICCYGPFTNMPTDQLEWMVQLCGASVVKELSSFTLGTGVHPIVVVQPDAWTEDNGFHAIGQMCEAPVVTREWVLDSVALYQCQELDTYLIPQIPHSHY

SEQ ID NO: 162 - protein, 1816 aa, Homo sapiens
MLKLLNQKKGPSQCPLCKNDITKRSLQESTRFSQLVEELLKIICAFQLDTGLEYANSYNFAKKENNSPEHLKDEVSIIQSMGYRNRAKRLLQSEPENPSLQETSLSVQLSNLGTVRTLRTKQRIQPQKTSVYIELGSDSSEDTVNKATYCSVGDQELLQITPQGTRDEISLDSAKKAACEFSETDVTNTEHHQPSNNDLNTTEKRAAERHPEKYQGSSVSNLHVEPCGTNTHASSLQHENSSLLLTKDRMNVEKAEFCNKSKQPGLARSQHNRWAGSKETCNDRRTPSTEKKVDLNADPLCERKEWNKQKLPCSENPRDTEDVPWITLNSSIQKVNEWFSRSDELLGSDDSHDGESESNAKVADVLDVLNEVDEYSGSSEKIDLLASDPHEALICKSERVHSKSVESNIEDKIFGKTYRKKASLPNLSHVTENLIIGAFVTEPQIIQERPLTNKLKRKRRPTSGLHPEDFIKKADLAVQKTPEMINQGTNQTEQNGQVMNITNSGHENKTKGDSIQNEKNPNPIESLEKESAFKTKAEPISSSISNMELELNIHNSKAPKKNRLRRKSSTRHIHALELVVSRNLSPPNCTELQIDSCSSSEEIKKKKYNQMPVRHSRNLQLMEGKEPATGAKKSNKPNEQTSKRHDSDTFPELKLTNAPGSFTKCSNTSELKEFVNPSLPREEKEEKLETVKVSNNAEDPKDLMLSGERVLQTERSVESSSISLVPGTDYGTQESISLLEVSTLGKAKTEPNKCVSQCAAFENPKGLIHGCSKDNRNDTEGFKYPLGHEVNHSRETSIEMEESELDAQYLQNTFKVSKRQSFAPFSNPGNAEEECATFSAHSGSLKKQSPKVTFECEQKEENQGKNESNIKPVQTVNITAGFPVVGQKDKPVDNAKCSIKGGSRFCLSSQFRGNETGLITPNKHGLLQNPYRIPPLFPIKSFVKTKCKKNLLEENFEEHSMSPEREMGNENIPSTVSTISRNNIRENVFKEASSSNINEVGSSTNEVGSSINEIGSSDENIQAELGRNRGPKLNAMLRLGVLQPEVYKQSLPGSNCKHPEIKKQEYEEVVQTVNTDFSPYLISDNLEQPMGSSHASQVCSETPDDLLDDGEIKEDTSFAENDIKESSAVFSKSVQKGELSRSPSPFTHTHLAQGYRRGAKKLESSEENLSSEDEELPCFQHLLFGKVNNIPSQSTRHSTVATECLSKNTEENLLSLKNSLNDCSNQVILAKASQEHHLSEETKCSASLFSSQCSELEDLTANTNTQDPFLIGSSKQMRHQSESQGVGLSDKELVSDDEERGTGLEENNQEEQSMDSNLGEAASGCESETSVSEDCSGLSSQSDILTTQQRDTMQHNLIKLQQEMAELEAVLEQHGSQPSNSYPSIISDSSALEDLRNPEQSTSEKAVLTSQKSSEYPISQNPEGLSADKFEVSADSSTSKNKEPGVERSSPSKCPSLDDRWYMHSCSGSLQNRNYPSQEELIKVVDVEEQQLEESGPHDLTETSYLPRQDLEGTPYLESGISLFSDDPESDPSEDRAPESARVGNIPSSTSALKVPQLKVAESAQSPAAAHTTDTAGYNAMEESVSREKPELTASTERVNKRMSMVVSGLTPEEFMLVYKFARKHHITLTNLITEETTHVVMKTDAEFVCERTLKYFLGIAGGKWVVSYFWVTQSIKERKMLNEHDFEVRGDVVNGRNHQGPKRARESQDRKIFRGLEICCYGPFTNMPTDQLEWMVQLCGASVVKELSSFTLGTGVHPIVVVQPDAWTEDNGFHAIGQMCEAPVVTREWVLDSVALYQCQELDTYLIPQIPHSHY

SEQ ID NO: 163 - protein, 1884 aa, Homo sapiens
MDLSALRVEEVQNVINAMQKILECPICLELIKEPVSTKCDHIFCKFCMLKLLNQKKGPSQCPLCKNDITKRSLQESTRFSQLVEELLKIICAFQLDTGLEYANSYNFAKKENNSPEHLKDEVSIIQSMGYRNRAKRLLQSEPENPSLQETSLSVQLSNLGTVRTLRTKQRIQPQKTSVYIELGSDSSEDTVNKATYCSVGDQELLQITPQGTRDEISLDSAKKAACEFSETDVTNTEHHQPSNNDLNTTEKRAAERHPEKYQGSSVSNLHVEPCGTNTHASSLQHENSSLLLTKDRMNVEKAEFCNKSKQPGLARSQHNRWAGSKETCNDRRTPSTEKKVDLNADPLCERKEWNKQKLPCSENPRDTEDVPWITLNSSIQKVNEWFSRSDELLGSDDSHDGESESNAKVADVLDVLNEVDEYSGSSEKIDLLASDPHEALICKSERVHSKSVESNIEDKIFGKTYRKKASLPNLSHVTENLIIGAFVTEPQIIQERPLTNKLKRKRRPTSGLHPEDFIKKADLAVQKTPEMINQGTNQTEQNGQVMNITNSGHENKTKGDSIQNEKNPNPIESLEKESAFKTKAEPISSSISNMELELNIHNSKAPKKNRLRRKSSTRHIHALELVVSRNLSPPNCTELQIDSCSSSEEIKKKKYNQMPVRHSRNLQLMEGKEPATGAKKSNKPNEQTSKRHDSDTFPELKLTNAPGSFTKCSNTSELKEFVNPSLPREEKEEKLETVKVSNNAEDPKDLMLSGERVLQTERSVESSSISLVPGTDYGTQESISLLEVSTLGKAKTEPNKCVSQCAAFENPKGLIHGCSKDNRNDTEGFKYPLGHEVNHSRETSIEMEESELDAQYLQNTFKVSKRQSFAPFSNPGNAEEECATFSAHSGSLKKQSPKVTFECEQKEENQGKNESNIKPVQTVNITAGFPVVGQKDKPVDNAKCSIKGGSRFCLSSQFRGNETGLITPNKHGLLQNPYRIPPLFPIKSFVKTKCKKNLLEENFEEHSMSPEREMGNENIPSTVSTISRNNIRENVFKEASSSNINEVGSSTNEVGSSINEIGSSDENIQAELGRNRGPKLNAMLRLGVLQPEVYKQSLPGSNCKHPEIKKQEYEEVVQTVNTDFSPYLISDNLEQPMGSSHASQVCSETPDDLLDDGEIKEDTSFAENDIKESSAVFSKSVQKGELSRSPSPFTHTHLAQGYRRGAKKLESSEENLSSEDEELPCFQHLLFGKVNNIPSQSTRHSTVATECLSKNTEENLLSLKNSLNDCSNQVILAKASQEHHLSEETKCSASLFSSQCSELEDLTANTNTQDPFLIGSSKQMRHQSESQGVGLSDKELVSDDEERGTGLEENNQEEQSMDSNLGEAASGCESETSVSEDCSGLSSQSDILTTQQRDTMQHNLIKLQQEMAELEAVLEQHGSQPSNSYPSIISDSSALEDLRNPEQSTSEKDSHIHGQRNNSMFSKRPREHISVLTSQKSSEYPISQNPEGLSADKFEVSADSSTSKNKEPGVERSSPSKCPSLDDRWYMHSCSGSLQNRNYPSQEELIKVVDVEEQQLEESGPHDLTETSYLPRQDLEGTPYLESGISLFSDDPESDPSEDRAPESARVGNIPSSTSALKVPQLKVAESAQSPAAAHTTDTAGYNAMEESVSREKPELTASTERVNKRMSMVVSGLTPEEFMLVYKFARKHHITLTNLITEETTHVVMKTDAEFVCERTLKYFLGIAGGKWVVSYFWVTQSIKERKMLNEHDFEVRGDVVNGRNHQGPKRARESQDRKIFRGLEICCYGPFTNMPTDQLEWMVQLCGASVVKELSSFTLGTGVHPIVVVQPDAWTEDNGFHAIGQMCEAPVVTREWVLDSVALYQCQELDTYLIPQIPHSHY

SEQ ID NO: 164 - protein, 759 aa, Homo sapiens
MDLSALRVEEVQNVINAMQKILECPICLELIKEPVSTKCDHIFCKFCMLKLLNQKKGPSQCPLCKNDITKRSLQESTRFSQLVEELLKIICAFQLDTGLEYANSYNFAKKENNSPEHLKDEVSIIQSMGYRNRAKRLLQSEPENPSLQETSLSVQLSNLGTVRTLRTKQRIQPQKTSVYIELGSDSSEDTVNKATYCSVGDQELLQITPQGTRDEISLDSAKKAACEFSETDVTNTEHHQPSNNDLNTTEKRAAERHPEKYQGEAASGCESETSVSEDCSGLSSQSDILTTQQRDTMQHNLIKLQQEMAELEAVLEQHGSQPSNSYPSIISDSSALEDLRNPEQSTSEKVLTSQKSSEYPISQNPEGLSADKFEVSADSSTSKNKEPGVERSSPSKCPSLDDRWYMHSCSGSLQNRNYPSQEELIKVVDVEEQQLEESGPHDLTETSYLPRQDLEGTPYLESGISLFSDDPESDPSEDRAPESARVGNIPSSTSALKVPQLKVAESAQSPAAAHTTDTAGYNAMEESVSREKPELTASTERVNKRMSMVVSGLTPEEFMLVYKFARKHHITLTNLITEETTHVVMKTDAEFVCERTLKYFLGIAGGKWVVSYFWVTQSIKERKMLNEHDFEVRGDVVNGRNHQGPKRARESQDRKIFRGLEICCYGPFTNMPTDQLEWMVQLCGASVVKELSSFTLGTGVHPIVVVQPDAWTEDNGFHAIGQMCEAPVVTREWVLDSVALYQCQELDTYLIPQIPHSHY

SEQ ID NO: 165 - protein, 699 aa, Homo sapiens
MDLSALRVEEVQNVINAMQKILECPICLELIKEPVSTKCDHIFCKFCMLKLLNQKKGPSQCPLCKNDITKRSLQESTRFSQLVEELLKIICAFQLDTGLEYANSYNFAKKENNSPEHLKDEVSIIQSMGYRNRAKRLLQSEPENPSLQETSLSVQLSNLGTVRTLRTKQRIQPQKTSVYIELGSDSSEDTVNKATYCSVGDQELLQITPQGTRDEISLDSAKKAACEFSETDVTNTEHHQPSNNDLNTTEKRAAERHPEKYQGEAASGCESETSVSEDCSGLSSQSDILTTQQRDTMQHNLIKLQQEMAELEAVLEQHGSQPSNSYPSIISDSSALEDLRNPEQSTSEKVLTSQKSSEYPISQNPEGLSADKFEVSADSSTSKNKEPGVERSSPSKCPSLDDRWYMHSCSGSLQNRNYPSQEELIKVVDVEEQQLEESGPHDLTETSYLPRQDLEGTPYLESGISLFSDDPESDPSEDRAPESARVGNIPSSTSALKVPQLKVAESAQSPAAAHTTDTAGYNAMEESVSREKPELTASTERVNKRMSMVVSGLTPEEFMLVYKFARKHHITLTNLITEETTHVVMKTDAEFVCERTLKYFLGIAGGKWVVSYFWVTQSIKERKMLNEHDFEVRGDVVNGRNHQGPKRARESQDRKIFRGLEICCYGPFTNMPTGCPPNCGCAARCLDRGQWLPCNWADV

SEQ ID NO: 166 - protein, 897 aa, Artificial Sequence
  Synthetic
MNISGSSCGSPNSADTSSDFKDLWTKLKECHDREVQGLQVKVTKLKQERILDAQRLEEFFTKNQQLREQQKVLHETIKVLEDRLRAGLCDRCAVTEEHMRKKQQEFENIRQQNLKLITELMNERNTLQEENKKLSEQLQQKIENDQQHQAAELECEEDVIPDSPITAFSFSGVNRLRRKENPHVRYIEQTHTKLEHSVCANEMRKVSKSSTHPQHNPNENEILVADTYDQSQSPMAKAHGTSSYTPDKSSFNLATVVAETLGLGVQEESETQGPMSPLGDELYHCLEGNHKKQPFEESTRNTEDSLRFSDSTSKTPPQEELPTRVSSPVFGATSSIKSGLDLNTSLSPSLLQPGKKKHLKTLPFSNTCISRLEKTRSKSEDSALFTHHSLGSEVNKIIIQSSNKQILINKNISESLGEQNRTEYGKDSNTDKHLEPLKSLGGRTSKRKKTEEESEHEVSCPQASFDKENAFPFPMDNQFSMNGDCVMDKPLDLSDRFSAIQRQEKSQGSETSKNKFRQVTLYEALKTIPKGFSSSRKASDGNCTLPKDSPGEPCSQECIILQPLNKCSPDNKPSLQIKEENAVFKIPLRPRESLETENVLDDIKSAGSHEPIKIQTRSDHGGCELASVLQLNPCRTGKIKSLQNNQDVSFENIQWSIDPGADLSQYKMDVTVIDTKDGSQSKLGGETVDMDCTLVSETVLLKMKKQEQKGEKSSNEERKMNDSLEDMFDRTTHEEYESCLADSFSQAADEEEELSTATKKLHTHGDKQDKVKQKAFVEPYFKGDERETSLQNFPHIEVVRKKEERRKLLGHTCKECEIYYADMPAEEREKKLASCSRHRFRYIPPNTPENFWEVGFPSTQTCMERGYIKEDLDPCPRPKRRQPYNAIFSPKGKEQKT

SEQ ID NO: 167 - protein, 867 aa, Artificial Sequence
  Synthetic
MNISGSSCGSPNSADTSSDFKDLWTKLKECHDREVQGLQVKVTKLKQERILDAQRLEEFFTKNQQLREQQKVLHETIKVLEDRLRAGLCDRCAVTEEHMRKKQQEFENIRQQNLKLITELMNERNTLQEENKKLSEQLQQKIENDQQHQAAELECEEDVIPDSPITAFSFSGVNRLRRKENPHVRYIEQTHTKLEHSVCANEMRKVSKSSTHPQHNPNENEILVADTYDQSQSPMAKAHGTSSYTPDKSSFNLATVVAETLGLGVQEESETQGPMSPLGDELYHCLEGNHKKQPFEESTRNTEDSLRFSDSTSKTPPQEELPTRVSSPVFGATSSIKSGLDLNTSLSPSLLQPGKKKHLKTLPFSNTCISRLEKTRSKSEDSALFTHHSLGSEVNKIIIQSSNKQILINKNISESLGEQNRTEYGKDSNTDKHLEPLKSLGGRTSKRKKTEEESEHEVSCPQASFDKENAFPFPMDNQFSMNGDCVMDKPLDLSDRFSAIQRQEKSQGSETSKNKFRQVTLYEALKTIPKGFSSSRKASDGNCTLPKDSPGEPCSQECIILQPLNKCSPDNKPSLQIKEENAVFKIPLRPRESLETENVLDDIKSAGSHEPIKIQTRSDHGGCELASVLQLNPCRTGKIKSLQNNQDVSFENIQWSIDPGADLSQYKMDVTVIDTKDGSQSKLGGETVDMDCTLVSETVLLKMKKQEQKGEKSSNEERKMNDSLEDMFDRTTHEEYESCLADSFSQAADEEEELSTATKKLHTHGDKQDKVKQKAFVEPYFKGDESIMQICQQKKEKRNWLPAQDTDSATFHPTHQRIFGKLVFLPLRLVWKEVILRKILILVLVQKDVSLTTQYFLQKARSRRHRR

SEQ ID NO: 168 - DNA, 2694 bp, Artificial Sequence
  Synthetic
atgaacatcttgggaagcagctgtggaagccctaactctgcagatacatctagtgactttaaggacctttggacaaaactaaaagaatgtcatgatagagaagtacaaggtttacaagtaaaagtaaccaagctaaaacaggaacgaatcttagatgcacaaagactagaagaattcttcaccaaaaatcaacagctgagggaacagcagaaagtccttcatgaaaccattaaagttttagaagatcggttaagagcaggcttatgtgatcgctgtgcagtaactgaagaacatatgcggaaaaaacagcaagagtttgaaaatatccggcagcagaatcttaaacttattacagaacttatgaatgaaaggaatactctacaggaagaaaataaaaagctttctgaacaactccagcagaaaattgagaatgatcaacagcatcaagcagctgagcttgaatgtgaggaagacgttattccagattcaccgataacagccttctcattttctggcgttaaccggctacgaagaaaggagaacccccatgtccgatacatagaacaaacacatactaaattggagcactctgtgtgtgcaaatgaaatgagaaaagtttccaagtcttcaactcatccacaacataatcctaatgaaaatgaaattctagtagctgacacttatgaccaaagtcaatctccaatggccaaagcacatggaacaagcagctatacccctgataagtcatcttttaatttagctacagttgttgctgaaacacttggacttggtgttcaagaagaatctgaaactcaaggtcccatgagcccccttggtgatgagctctaccactgtctggaaggaaatcacaagaaacagccttttgaggaatctacaagaaatactgaagatagtttaagattttcagattctacttcaaagactcctcctcaagaagaattacctactcgagtgtcatctcctgtatttggagctacctctagtatcaaaagtggtttagatttgaatacaagtttgtccccttctcttttacagcctgggaaaaaaaaacatctgaaaacactcccttttagcaacacttgtatatctagattagaaaaaactagatcaaaatctgaagatagtgcccttttcacacatcacagtcttgggtctgaagtgaacaagatcattatccagtcatctaataaacagatacttataaataaaaatataagtgaatccctaggtgaacagaataggactgagtacggtaaagattctaacactgataaacatttggagcccctgaaatcattgggaggccgaacatccaaaaggaagaaaactgaggaagaaagtgaacatgaagtaagctgcccccaagcttcttttgataaagaaaatgctttcccttttccaatggataatcagttttccatgaatggagactgtgtgatggataaacctctggatctgtctgatcgattttcagctattcagcgtcaagagaaaagccaaggaagtgagacttctaaaaacaaatttaggcaagtgactctttatgaggctttgaagaccattccaaagggcttttcctcaagccgtaaggcctcagatggcaactgcacgttgcccaaagattccccaggggagccctgttcacaggaatgcatcatccttcagcccttgaataaatgctctccagacaataaaccatcattacaaataaaagaagaaaatgctgtctttaaaattcctctacgtccacgtgaaagtttggagactgagaatgttttagatgacataaagagtgctggttctcatgagccaataaaaatacaaaccaggtcagaccatggaggatgtgaacttgcatcagttcttcagttaaatccatgtagaactggtaaaataaagtctctacaaaacaaccaagatgtatcctttgaaaatatccagtggagtatagatccgggagcagacctttctcagtataaaatggatgttactgtaatagatacaaaggatggcagtcagtcaaaattaggaggagagacagtggacatggactgtacattggttagtgaaaccgttctcttaaaaatgaagaagcaagagcagaagggagaaaaaagttcaaatgaagaaagaaaaatgaatgatagcttggaagatatgtttgatcggacaacacatgaagagtatgaatcctgtttggcagacagtttctcccaagcagcagatgaagaggaggaattgtctactgccacaaagaaactacacactcatggtgataaacaagacaaagtcaagcagaaagcgtttgtggagccgtattttaaaggtgatgaaagagagactagcttgcaaaattttcctcatattgaggtggttcggaaaaaagaggagagaagaaaactgcttgggcacacgtgtaaggaatgtgaaatttattatgcagatatgccagcagaagaaagagaaaagaaattggcttcctgctcaagacaccgattccgctacattccacccaacacaccagagaatttttgggaagttggttttccttccactcagacttgtatggaaagaggttatattaaggaagatcttgatccttgtcctcgtccaaaaagacgtcagccttacaacgcaatattttctccaaaaggcaaggagcagaagacataa

SEQ ID NO: 169 - protein, 911 aa, Artificial Sequence
  Synthetic
MNILGSSCGSPNSADTSSDFKDLWTKLKECHDREVQGLQVKVTKLKQERILDAQRLEEFFTKNQQLREQQKVLHETIKVLEDRLRAGLCDRCAVTEEHMRKKQQEFENIRQQNLKLITELMNERNTLQEENKKLSEQLQQKIENDQQHQAAELECEEDVIPDSPITAFSFSGVNRLRRKENPHVRYIEQTHTKLEHSVCANEMRKVSKSSTHPQHNPNENEILVADTYDQSQSPMAKAHGTSSYTPDKSSFNLATVVAETLGLGVQEESETQGPMSPLGDELYHCLEGNHKKQPFEESTRNTEDSLRFSDSTSKTPPQEELPTRVSSPVFGATSSIKSGLDLNTSLSPSLLQPGKKKHLKTLPFSNTCISRLEKTRSKSEDSALFTHHSLGSEVNKIIIQSSNKQILINKNISESLGEQNRTEYGKDSNTDKHLEPLKSLGGRTSKRKKTEEESEHEVSCPQASFDKENAFPFPMDNQFSMNGDCVMDKPLDLSDRFSAIQRQEKSQGSETSKNKFRQVTLYEALKTIPKGFSSSRKASDGNCTLPKDSPGEPCSQECIILQPLNKCSPDNKPSLQIKEENAVFKIPLRPRESLETENVLDDIKSAGSHEPIKIQTRSDHGGCELASVLQLNPCRTGKIKSLQNNQDVSFENIQWSIDPGADLSQYKMDVTVIDTKDGSQSKLGGETVDMDCTLVSETVLLKMKKQEQKGEKSSNEERKMNDSLEDMFDRTTHEEYESCLADSFSQAADEEEELSTATKKLHTHGDKQDKVKQKAFVEPYFKGDERETSLQNFPHIEVVRKKEERRKLLGHTCKECEIYYADMPAEEREKKLASCSRHRFRYIPPNTPENFWEVGFPSTQTCMERGYIKEDLDPCPRPKRRQPYNAIFSPKGKEQKTDYKDHDGDYKDHDI

SEQ ID NO: 170 - protein, 2694 aa, Artificial Sequence
  Synthetic
ATGAACATCTTGGGAAGCAGCTGTGGAAGCCCTAACTCTGCAGATACATCTAGTGACTTTAAGGACCTTTGGACAAAACTAAAAGAATGTCATGATAGAGAAGTACAAGGTTTACAAGTAAAAGTAACCAAGCTAAAACAGGAACGAATCTTAGATGCACAAAGACTAGAAGAATTCTTCACCAAAAATCAACAGCTGAGGGAACAGCAGAAAGTCCTTCATGAAACCATTAAAGTTTTAGAAGATCGGTTAAGAGCAGGCTTATGTGATCGCTGTGCAGTAACTGAAGAACATATGCGGAAAAAACAGCAAGAGTTTGAAAATATCCGGCAGCAGAATCTTAAACTTATTACAGAACTTATGAATGAAAGGAATACTCTACAGGAAGAAAATAAAAAGCTTTCTGAACAACTCCAGCAGAAAATTGAGAATGATCAACAGCATCAAGCAGCTGAGCTTGAATGTGAGGAAGACGTTATTCCAGATTCACCGATAACAGCCTTCTCATTTTCTGGCGTTAACCGGCTACGAAGAAAGGAGAACCCCCATGTCCGATACATAGAACAAACACATACTAAATTGGAGCACTCTGTGTGTGCAAATGAAATGAGAAAAGTTTCCAAGTCTTCAACTCATCCACAACATAATCCTAATGAAAATGAAATTCTAGTAGCTGACACTTATGACCAAAGTCAATCTCCAATGGCCAAAGCACATGGAACAAGCAGCTATACCCCTGATAAGTCATCTTTTAATTTAGCTACAGTTGTTGCTGAAACACTTGGACTTGGTGTTCAAGAAGAATCTGAAACTCAAGGTCCCATGAGCCCCCTTGGTGATGAGCTCTACCACTGTCTGGAAGGAAATCACAAGAAACAGCCTTTTGAGGAATCTACAAGAAATACTGAAGATAGTTTAAGATTTTCAGATTCTACTTCAAAGACTCCTCCTCAAGAAGAATTACCTACTCGAGTGTCATCTCCTGTATTTGGAGCTACCTCTAGTATCAAAAGTGGTTTAGATTTGAATACAAGTTTGTCCCCTTCTCTTTTACAGCCTGGGAAAAAAAAACATCTGAAAACACTCCCTTTTAGCAACACTTGTATATCTAGATTAGAAAAAACTAGATCAAAATCTGAAGATAGTGCCCTTTTCACACATCACAGTCTTGGGTCTGAAGTGAACAAGATCATTATCCAGTCATCTAATAAACAGATACTTATAAATAAAAATATAAGTGAATCCCTAGGTGAACAGAATAGGACTGAGTACGGTAAAGATTCTAACACTGATAAACATTTGGAGCCCCTGAAATCATTGGGAGGCCGAACATCCAAAAGGAAGAAAACTGAGGAAGAAAGTGAACATGAAGTAAGCTGCCCCCAAGCTTCTTTTGATAAAGAAAATGCTTTCCCTTTTCCAATGGATAATCAGTTTTCCATGAATGGAGACTGTGTGATGGATAAACCTCTGGATCTGTCTGATCGATTTTCAGCTATTCAGCGTCAAGAGAAAAGCCAAGGAAGTGAGACTTCTAAAAACAAATTTAGGCAAGTGACTCTTTATGAGGCTTTGAAGACCATTCCAAAGGGCTTTTCCTCAAGCCGTAAGGCCTCAGATGGCAACTGCACGTTGCCCAAAGATTCCCCAGGGGAGCCCTGTTCACAGGAATGCATCATCCTTCAGCCCTTGAATAAATGCTCTCCAGACAATAAACCATCATTACAAATAAAAGAAGAAAATGCTGTCTTTAAAATTCCTCTACGTCCACGTGAAAGTTTGGAGACTGAGAATGTTTTAGATGACATAAAGAGTGCTGGTTCTCATGAGCCAATAAAAATACAAACCAGGTCAGACCATGGAGGATGTGAACTTGCATCAGTTCTTCAGTTAAATCCATGTAGAACTGGTAAAATAAAGTCTCTACAAAACAACCAAGATGTATCCTTTGAAAATATCCAGTGGAGTATAGATCCGGGAGCAGACCTTTCTCAGTATAAAATGGATGTTACTGTAATAGATACAAAGGATGGCAGTCAGTCAAAATTAGGAGGAGAGACAGTGGACATGGACTGTACATTGGTTAGTGAAACCGTTCTCTTAAAAATGAAGAAGCAAGAGCAGAAGGGAGAAAAAAGTTCAAATGAAGAAAGAAAAATGAATGATAGCTTGGAAGATATGTTTGATCGGACAACACATGAAGAGTATGAATCCTGTTTGGCAGACAGTTTCTCCCAAGCAGCAGATGAAGAGGAGGAATTGTCTACTGCCACAAAGAAACTACACACTCATGGTGATAAACAAGACAAAGTCAAGCAGAAAGCGTTTGTGGAGCCGTATTTTAAAGGTGATGAAAGAGAGACTAGCTTGCAAAATTTTCCTCATATTGAGGTGGTTCGGAAAAAAGAGGAGAGAAGAAAACTGCTTGGGCACACGTGTAAGGAATGTGAAATTTATTATGCAGATATGCCAGCAGAAGAAAGAGAAAAGAAATTGGCTTCCTGCTCAAGACACCGATTCCGCTACATTCCACCCAACGAACCAGAGAATTTTTGGGAAGTTGGTTTTCCTTCCACTCAGACTTGTATGGAAAGAGGTTATATTAAGGAAGATCTTGATCCTTGTCCTCGTCCAAAAAGACGTCAGCCTTACAACGCAATATTTTCTCCAAAAGGCAAGGAGCAGAAGACATAA

SEQ ID NO: 171 - protein, 911 aa, Artificial Sequence
  Synthetic
MNILGSSCGSPNSADTSSDFKDLWTKLKECHDREVQGLQVKVTKLKQERILDAQRLEEFFTKNQQLREQQKVLHETIKVLEDRLRAGLCDRCAVTEEHMRKKQQEFENIRQQNLKLITELMNERNTLQEENKKLSEQLQQKIENDQQHQAAELECEEDVIPDSPITAFSFSGVNRLRRKENPHVRYIEQTHTKLEHSVCANEMRKVSKSSTHPQHNPNENEILVADTYDQSQSPMAKAHGTSSYTPDKSSFNLATVVAETLGLGVQEESETQGPMSPLGDELYHCLEGNHKKQPFEESTRNTEDSLRFSDSTSKTPPQEELPTRVSSPVFGATSSIKSGLDLNTSLSPSLLQPGKKKHLKTLPFSNTCISRLEKTRSKSEDSALFTHHSLGSEVNKIIIQSSNKQILINKNISESLGEQNRTEYGKDSNTDKHLEPLKSLGGRTSKRKKTEEESEHEVSCPQASFDKENAFPFPMDNQFSMNGDCVMDKPLDLSDRFSAIQRQEKSQGSETSKNKFRQVTLYEALKTIPKGFSSSRKASDGNCTLPKDSPGEPCSQECIILQPLNKCSPDNKPSLQIKEENAVFKIPLRPRESLETENVLDDIKSAGSHEPIKIQTRSDHGGCELASVLQLNPCRTGKIKSLQNNQDVSFENIQWSIDPGADLSQYKMDVTVIDTKDGSQSKLGGETVDMDCTLVSETVLLKMKKQEQKGEKSSNEERKMNDSLEDMFDRTTHEEYESCLADSFSQAADEEEELSTATKKLHTHGDKQDKVKQKAFVEPYFKGDERETSLQNFPHIEVVRKKEERRKLLGHTCKECEIYYADMPAEEREKKLASCSRHRFRYIPPNEPENFWEVGFPSTQTCMERGYIKEDLDPCPRPKRRQPYNAIFSPKGKEQKTDYKDHDGDYKDHDI

SEQ ID NO: 172 - protein, 803 aa, Artificial Sequence
  Synthetic
MGIQGLLQFIKEASEPIHVRKYKGQVVAVDTYCWLHKGAIACAEKLAKGEPTDRYVGFCMKFVNMLLSHGIKPILVFDGCTLPSKKEVERSRRERRQANLLKGKQLLREGKVSEARECFTRSINITHAMAHKVIKAARSQGVDCLVAPYEADAQLAYLNKAGIVQAIITEDSDLLAFGCKKVILKMDQFGNGLEIDQARLGMCRQLGDVFTEEKFRYMCILSGCDYLSSLRGIGLAKACKVLRLANNPDIVKVIKKIGHYLKMNITVPEDYINGFIRANNTFLYQLVFDPIKRKLIPLNAYEDDVDPETLSYAGQYVDDSIALQIALGNKDINTFEQIDDYNPDTAMPAHSRSHSWDDKTCQKSANVSSIWHRNYSPRPESGTVSDAPQLKENPSTVGVERVISTKGLNLPRKSSIVKRPRSAELSEDDLLSQYSLSFTKKTKKNSSEGNKSLSFSEVFVPDLVNGPTNKKSVSTPPRTRNKFATFLQRKNEESGAVVVPGTRSRFFCSSDSTDCVSNKVSIQPLDETAVTDKENNLHESEYGDQEGKRLVDTDVARNSSDDIPNNHIPGDHIPDKATVFTDEESYSFESSKFTRTISPPTLGTLRSCFSWSGGLGDFSRTPSPSPSTALQQFRRKSDSPTSLPENNMSDVSQLKSEESSDDESHPLREEACSSQSQESGEFSLQSSNASKLSQCSSKDSDSEESDCNIKLLDSQSDQTSKLRLSHFSKKDTPLRNKVPGLYKSSSADSLSTTKIKPLGPARASGLSKKPASIQKRKHHNAENKPGLQIKLNELWKNFGFKKF

SEQ ID NO: 173 - protein, 846 aa, Artificial Sequence
  Synthetic
MGIQGLLQFIKEASEPIHVRKYKGQVVAVDTYCWLHKGAIACAEKLAKGEPTDRYVGFCMKFVNMLLSHGIKPILVFDGCTLPSKKEVERSRRERRQANLLKGKQLLREGKVSEARECFTRSINITHAMAHKVIKAARSQGVDCLVAPYEADAQLAYLNKAGIVQAIITEDSDLLAFGCKKVILKMDQFGNGLEIDQARLGMCRQLGDVFTEEKFRYMCILSGCDYLSSLRGIGLAKACKVLRLANNPDIVKVIKKIGHYLKMNITVPEDYINGFIRANNTFLYQLVFDPIKRKLIPLNAYEDDVDPETLSYAGQYVDDSIALQIALGNKDINTFEQIDDYNPDTAMPAHSRSHSWDDKTCQKSANVSSIWHRNYSPRPESGTVSDAPQLKENPSTVGVERVISTKGLNLPRKSSIVKRPRSAELSEDDLLSQYSLSFTKKTKKNSSEGNKSLSFSEVFVPDLVNGPTNKKSVSTPPRTRNKFATFLQRKNEESGAVVVPGTRSRFFCSSDSTDCVSNKVSIQPLDETAVTDKENNLHESEYGDQEGKRLVDTDVARNSSDDIPNNHIPGDHIPDKATVFTDEESYSFESSKFTRTISPPTLGTLRSCFSWSGGLGDFSRTPSPSPSTALQQFRRKSDSPTSLPENNMSDVSQLKSEESSDDESHPLREEACSSQSQESGEFSLQSSNASKLSQCSSKDSDSEESDCNIKLLDSQSDQTSKLRLSHFSKKDTPLRNKVPGLYKSSSADSLSTTKIKPLGPARASGLSKKPASIQKRKHHNAENKPGLQIKLNELWKNFGFKKDSEKLPPCKKPLSPVRDNIQLTPEAEEDIFNKPECGRVQRAIFQ

SEQ ID NO: 174 - protein, 1417 aa, Artificial Sequence
  Synthetic
MAAVPQNNLQEQLERHSARTLNNKLSLSKPKFSGFTFKKKTSSDNNVSVTNVSVAKTPVLRNKDVNVTEDFSFSEPLPNTTNQQRVKDFFKNAPAGQETQRGGSKSLLPDFLQTPKEVVCTTQNTPTVKKSRDTALKKLEFSSSPDSLSTINDWDDMDDFDTSETSKSFVTPPQSHFVRVSTAQKSKKGKRNFFKAQLYTTNTVKTDLPPPSSESEQIDLTEEQKDDSEWLSSDVICIDDGPIAEVHINEDAQESDSLKTHLEDERDNSEKKKNLEEAELHSTEKVPCIEFDDDDYDTDFVPPSPEEIISASSSSSKCLSTLKDLDTSDRKEDVLSTSKDLLSKPEKMSMQELNPETSTDCDARQISLQQQLIHVMEHICKLIDTIPDDKLKLLDCGNELLQQRNIRRKLLTEVDFNKSDASLLGSLWRYRPDSLDGPMEGDSCPTGNSMKELNFSHLPSNSVSPGDCLLTTTLGKTGFSATRKNLFERPLFNTHLQKSFVSSNWAETPRLGKKNESSYFPGNVLTSTAVKDQNKHTASINDLERETQPSYDIDNFDIDDFDDDDDWEDIMHNLAASKSSTAAYQPIKEGRPIKSVSERLSSAKTDCLPVSSTAQNINFSESIQNYTDKSAQNLASRNLKHERFQSLSFPHTKEMMKIFHKKFGLHNFRTNQLEAINAALLGEDCFILMPTGGGKSLCYQLPACVSPGVTVVISPLRSLIVDQVQKLTSLDIPATYLTGDKTDSEATNIYLQLSKKDPIIKLLYVTPEKICASNRLISTLENLYERKLLARFVIDEAHCVSQWGHDFRQDYKRMNMLRQKFPSVPVMALTATANPRVQKDILTQLKILRPQVFSMSFNRHNLKYYVLPKKPKKVAFDCLEWIRKHHPYDSGIIYCLSRRECDTMADTLQRDGLAALAYHAGLSDSARDEVQQKWINQDGCQVICATIAFGMGIDKPDVRFVIHASLPKSVEGYYQESGRAGRDGEISHCLLFYTYHDVTRLKRLIMMEKDGNHHTRETHFNNLYSMVHYCENITECRRIQLLAYFGENGFNPDFCKKHPDVSCDNCCKTKDYKTRDVTDDVKSIVRFVQEHSSSQGMRNIKHVGPSGRFTMNMLVDIFLGSKSAKIQSGIFGKGSAYSRHNAERLFKKLILDKILDEDLYINANDQAIAYVMLGNKAQTVLNGNLKVDFMETENSSSVKKQKALVAKVSQREEMVKKCLGELTEVCKSLGKVFGVHYFNIFNTVTLKKLAESLSSDPEVLLQIDGVTEDKLEKYGAEVISVLQKYSEWTSPAEDSSPGISLSSSRGPGRSAAEELDEEIPVSSHYFASKTRNERKRKKMPASQRSKRRKTASSGSKAKGGSATCRKISSKTKSSSIIGSSSASHTSQATSGANSKLGIMAPPKPINRPFLKPSYAFS

SEQ ID NO: 175 - protein, 1286 aa, Artificial Sequence
  Synthetic
MAAVPQNNLQEQLERHSARTLNNKLSLSKPKFSGFTFKKKTSSDNNVSVTNVSVAKTPVLRNKDVNVTEDFSFSEPLPNTTNQQRVKDFFKNAPAGQETQRGGSKSLLPDFLQTPKEVVCTTQNTPTVKKSRDTALKKLEFSSSPDSLSTINDWDDMDDFDTSETSKSFVTPPQSHFVRVSTAQKSKKGKRNFFKAQLYTTNTVKTDLPPPSSESEQIDLTEEQKDDSEWLSSDVICIDDGPIAEVHINEDAQESDSLKTHLEDERDNSEKKKNLEEAELHSTEKVPCIEFDDDDYDTDFVPPSPEEIISASSSSSKCLSTLKDLDTSDRKEDVLSTSKDLLSKPEKMSMQELNPETSTDCDARQISLQQQLIHVMEHICKLIDTIPDDKLKLLDCGNELLQQRNIRRKLLTEVDFNKSDASLLGSLWRYRPDSLDGPMEGDSCPTGNSMKELNFSHLPSNSVSPGDCLLTTTLGKTGFSATRKNLFERPLFNTHLQKSFVSSNWAETPRLGKKNESSYFPGNVLTSTAVKDQNKHTASINDLERETQPSYDIDNFDIDDFDDDDDWEDIMHNLAASKSSTAAYQPIKEGRPIKSVSERLSSAKTDCLPVSSTAQNINFSESIQNYTDKSAQNLASRNLKHERFQSLSFPHTKEMMKIFHKKFGLHNFRTNQLEAINAALLGEDCFILMPTGGGKSLCYQLPACVSPGVTVVISPLRSLIVDQVQKLTSLDIPATYLTGDKTDSEATNIYLQLSKKDPIIKLLYVTPEKICASNRLISTLENLYERKLLARFVIDEAHCVSQWGHDFRQDYKRMNMLRQKFPSVPVMALTATANPRVQKDILTQLKILRPQVFSMSFNRHNLKYYVLPKKPKKVAFDCLEWIRKHHPYDSGIIYCLSRRECDTMADTLQRDGLAALAYHAGLSDSARDEVQQKWINQDGCQVICATIAFGMGIDKPDVRFVIHASLPKSVEGYYQESGRAGRDGEISHCLLFYTYHDVTRLKRLIMMEKDGNHHTRETHFNNLYSMVHYCENITECRRIQLLAYFGENGFNPDFCKKHPDVSCDNCCKTKDYKTRDVTDDVKSIVRFVQEHSSSQGMRNIKHVGPSGRFTMNMLVDIFLESLSSDPEVLLQIDGVTEDKLEKYGAEVISVLQKYSEWTSPAEDSSPGISLSSSRGPGRSAAEELDEEIPVSSHYFASKTRNERKRKKMPASQRSKRRKTASSGSKAKGGSATCRKISSKTKSSSIIGSSSASHTSQATSGANSKLGIMAPPKPINRPFLKPSYAFS

SEQ ID NO: 176 - protein, 649 aa, Artificial Sequence
  Synthetic
MASVSALTEELDSITSELHAVEIQIQELTERQQELIQKKKVLTKKIKQCLEDSDAGASNEYDSSPAAWNKEDFPWSGKVKDILQNVFKLEKFRPLQLETINVTMAGKEVFLVMPTGGGKSLCYQLPALCSDGFTLVICPLISLMEDQLMVLKQLGISATMLNASSSKEHVKWVHAEMVNKNSELKLIYVTPEKIAKSKMFMSRLEKAYEARRFTRIAVDEVHCCSQWGHDFRPDYKALGILKRQFPNASLIGLTATATNHVLTDAQKILCIEKCFTFTASFNRPNLYYEVRQKPSNTEDFIEDIVKLINGRYKGQSGIIYCFSQKDSEQVTVSLQNLGIHAGAYHANLEPEDKTTVHRKWSANEIQVVVATVAFGMGIDKPDVRFVIHHSMSKSMENYYQESGRAGRDDMKADCILYYGFGDIFRISSMVVMENVGQQKLYEMVSYCQNISKCRRVLMAQHFDEVWNSEACNKMCDNCCKDSAFERKNITEYCRDLIKILKQAEELNEKLTPLKLIDSWMGKGAAKLRVAGVVAPTLPREDLEKIIAHFLIQQYLKEDYSFTAYATISYLKIGPKANLLNNEAHAITMQVTKSTQNSFRAESSQTCHSEQGDKKMEEKNSGNFQKKAANMLQQSGSKNTGAKKRKIDDA

SEQ ID NO: 177 - protein, 1432 aa, Artificial Sequence
  Synthetic
MSEKKLETTAQQRKCPEWMNVQNKRCAVEERKACVRKSVFEDDLPFLEFTGSIVYSYDASDCSFLSEDISMSLSDGDVVGFDMEWPPLYNRGKLGKVALIQLCVSESKCYLFHVSSMSVFPQGLKMLLENKAVKKAGVGIEGDQWKLLRDFDIKLKNFVELTDVANKKLKCTETWSLNSLVKHLLGKQLLKDKSIRCSNWSKFPLTEDQKLYAATDAYAGFIIYRNLEILDDTVQRFAINKEEEILLSDMNKQLTSISEEVMDLAKHLPHAFSKLENPRRVSILLKDISENLYSLRRMIIGSTNIETELRPSNNLNLLSFEDSTTGGVQQKQIREHEVLIHVEDETWDPTLDHLAKHDGEDVLGNKVERKEDGFEDGVEDNKLKENMERACLMSLDITEHELQILEQQSQEEYLSDIAYKSTEHLSPNDNENDTSYVIESDEDLEMEMLKHLSPNDNENDTSYVIESDEDLEMEMLKSLENLNSGTVEPTHSKCLKMERNLGLPTKEEEEDDENEANEGEEDDDKDFLWPAPNEEQVTCLKMYFGHSSFKPVQWKVIHSVLEERRDNVAVMATGYGKSLCFQYPPVYVGKIGLVISPLISLMEDQVLQLKMSNIPACFLGSAQSENVLTDIKLGKYRIVYVTPEYCSGNMGLLQQLEADIGITLIAVDEAHCISEWGHDFRDSFRKLGSLKTALPMVPIVALTATASSSIREDIVRCLNLRNPQITCTGFDRPNLYLEVRRKTGNILQDLQPFLVKTSSHWEFEGPTIIYCPSRKMTQQVTGELRKLNLSCGTYHAGMSFSTRKDIHHRFVRDEIQCVIATIAFGMGINKADIRQVIHYGAPKDMESYYQEIGRAGRDGLQSSCHVLWAPADINLNRHLLTEIRNEKFRLYKLKMMAKMEKYLHSSRCRRQIILSHFEDKQVQKASLGIMGTEKCCDNCRSRLDHCYSMDDSEDTSWDFGPQAFKLLSAVDILGEKFGIGLPILFLRGSNSQRLADQYRRHSLFGTGKDQTESWWKAFSRQLITEGFLVEVSRYNKFMKICALTKKGRNWLHKANTESQSLILQANEELCPKKLLLPSSKTVSSGTKEHCYNQVPVELSTEKKSNLEKLYSYKPCDKISSGSNISKKSIMVQSPEKAYSSSQPVISAQEQETQIVLYGKLVEARQKHANKMDVPPAILATNKILVDMAKMRPTTVENVKRIDGVSEGKAAMLAPLLEVIKHFCQTNSVQTDLFSSTKPQEEQKTSLVAKNKICTLSQSMAITYSLFQEKKMPLKSIAESRILPLMTIGMHLSQAVKAGCPLDLERAGLTPEVQKIIADVIRNPPVNSDMSKISLIRMLVPENIDTYLIHMAIEILKHGPDSGLQPSCDVNKRRCFPGSEEICSSSKRSKEEVGINTETSSAERKRRLPVWFAKGSDTSKKLMDKTKRGGLFS

SEQ ID NO: 178 - protein, 1208 aa, Artificial Sequence
  Synthetic
MERLRDVRERLQAWERAFRRQRGRRPSQDDVEAAPEETRALYREYRTLKRTTGQAGGGLRSSESLPAAAEEAPEPRCWGPHLNRAATKSPQSTPGRSRQGSVPDYGQRLKANLKGTLQAGPALGRRPWPLGRASSKASTPKPPGTGPVPSFAEKVSDEPPQLPEPQPRPGRLQHLQASLSQRLGSLDPGWLQRCHSEVPDFLGAPKACRPDLGSEESQLLIPGESAVLGPGAGSQGPEASAFQEVSIRVGSPQPSSSGGEKRRWNEEPWESPAQVQQESSQAGPPSEGAGAVAVEEDPPGEPVQAQPPQPCSSPSNPRYHGLSPSSQARAGKAEGTAPLHIFPRLARHDRGNYVRLNMKQKHYVRGRALRSRLLRKQAWKQKWRKKGECFGGGGATVTTKESCFLNEQFDHWAAQCPRPASEEDTDAVGPEPLVPSPQPVPEVPSLDPTVLPLYSLGPSGQLAETPAEVFQALEQLGHQAFRPGQERAVMRILSGISTLLVLPTGAGKSLCYQLPALLYSRRSPCLTLVVSPLLSLMDDQVSGLPPCLKAACIHSGMTRKQRESVLQKIRAAQVHVLMLTPEALVGAGGLPPAAQLPPVAFACIDEAHCLSQWSHNFRPCYLRVCKVLRERMGVHCFLGLTATATRRTASDVAQHLAVAEEPDLHGPAPVPTNLHLSVSMDRDTDQALLTLLQGKRFQNLDSIIIYCNRREDTERIAALLRTCLHAAWVPGSGGRAPKTTAEAYHAGMCSRERRRVQRAFMQGQLRVVVATVAFGMGLDRPDVRAVLHLGLPPSFESYVQAVGRAGRDGQPAHCHLFLQPQGEDLRELRRHVHADSTDFLAVKRLVQRVFPACTCTCTRPPSEQEGAVGGERPVPKYPPQEAEQLSHQAAPGPRRVCMGHERALPIQLTVQALDMPEEAIETLLCYLELHPHHWLELLATTYTHCRLNCPGGPAQLQALAHRCPPLAVCLAQQLPEDPGQGSSSVEFDMVKLVDSMGWELASVRRALCQLQWDHEPRTGVRRGTGVLVEFSELAFHLRSPGDLTAEEKDQICDFLYGRVQARERQALARLRRTFQAFHSVAFPSCGPCLEQQDEERSTRLKDLLGRYFEEEEGQEPGGMEDAQGPEPGQARLQDWEDQVRCDIRQFLSLRPEEKFSSRAVARIFHGIGSPCYPAQVYGQDRRFWRKYLHLSFHALVGLATEELLQVAR

SEQ ID NO: 179 - protein, 991 aa, Homo sapiens
MSSHHTTFPFDPERRVRSTLKKVFGFDSFKTPLQESATMAVVKGNKDVFVCMPTGAGKSLCYQLPALLAKGITIVVSPLIALIQDQVDHLLTLKVRVSSLNSKLSAQERKELLADLEREKPQTKILYITPEMAASSSFQPTLNSLVSRHLLSYLVVDEAHCVSQWGHDFRPDYLRLGALRSRLGHAPCVALTATATPQVQEDVFAALHLKKPVAIFKTPCFRANLFYDVQFKELISDPYGNLKDFCLKALGQEADKGLSGCGIVYCRTREACEQLAIELSCRGVNAKAYHAGLKASERTLVQNDWMEEKVPVIVATISFGMGVDKANVRFVAHWNIAKSMAGYYQESGRAGRDGKPSWCRLYYSRNDRDQVSFLIRKEVAKLQEKRGNKASDKATIMAFDALVTFCEELGCRHAAIAKYFGDALPACAKGCDHCQNPTAVRRRLEALERSSSWSKTCIGPSQGNGFDPELYEGGRKGYGDFSRYDEGSGGSGDEGRDEAHKREWNLFYQKQMQLRKGKDPKIEEFVPPDENCPLKEASSRRIPRLTVKAREHCLRLLEEALSSNRQSTRTADEADLRAKAVELEHETFRNAKVANLYKASVLKKVADIHRASKDGQPYDMGGSAKSCSAQAEPPEPNEYDIPPASHVYSLKPKRVGAGFPKGSCPFQTATELMETTRIREQAPQPERGGEHEPPSRPCGLLDEDGSEPLPGPRGEVPGGSAHYGGPSPEKKAKSSSGGSSLAKGRASKKQQLLATAAHKDSQSIARFFCRRVESPALLASAPEAEGACPSCEGVQGPPMAPEKYTGEEDGAGGHSPAPPQTEECLRERPSTCPPRDQGTPEVQPTPAKDTWKGKRPRSQQENPESQPQKRPRPSAKPSVVAEVKGSVSASEQGTLNPTAQDPFQLSAPGVSLKEAANVVVKCLTPFYKEGKFASKELFKGFARHLSHLLTQKTSPGRSVKEEAQNLIRHFFHGRARCESEADWHGLCGPQR

SEQ ID NO: 180 - protein, 435 aa, Homo sapiens
MSSHHTTFPFDPERRVRSTLKKVFGFDSFKTPLQESATMAVVKGNKDVFVCMPTGAGKSLCYQLPALLAKGITIVVSPLIALIQDQVDHLLTLKVRVSSLNSKLSAQERKELLADLEREKPQTKILYITPEMAASSSFQPTLNSLVSRHLLSYLVVDEAHCVSQWGHDFRPDYLRLGALRSRLGHAPCVALTATATPQVQEDVFAALHLKKPVAIFKTPCFRANLFYDVQFKELISDPYGNLKDFCLKALGQEADKGLSGCGIVYCRTREACEQLAIELSCRGVNAKAYHAGLKASERTLVQNDWMEEKVPVIVATISFGMGVDKANVRFVAHWNIAKSMAGYYQESGRAGRDGKPSWCRLYYSRNDRDQVSFLIRKEVAKLQEKRGNKASDKATIMAFDALVTFCEELGRWGRGHGKSLRAAWCSQVVSRHAEL

SEQ ID NO: 181 - protein, 410 aa, Artificial Sequence
  Synthetic
MSSHHTTFPFDPERRVRSTLKKVFGFDSFKTPLQESATMAVVKGNKDVFVCMPTGAGKSLCYQLPALLAKGITIVVSPLIALIQDQVDHLLTLKVRVSSLNSKLSAQERKELLADLEREKPQTKILYITPEMAASSSFQPTLNSLVSRHLLSYLVVDEAHCVSQWGHDFRPDYLRLGALRSRLGHAPCVALTATATPQVQEDVFAALHLKKPVAIFKTPCFRANLFYDVQFKELISDPYGNLKDFCLKALGQEADKGLSGCGIVYCRTREACEQLAIELSCRGVNAKAYHAGLKASERTLVQNDWMEEKVPVIVATISFGMGVDKANVRFVAHWNIAKSMAGYYQESGRAGRDGKPSWCRLYYSRNDRDQVSFLIRKEVAKLQEKRGNKASDKATIMAFDALVTFCEELG

SEQ ID NO: 182 - protein, 121 aa, Homo sapiens
MVDMMDLPRSRINAGMLAQFIDKPVCFVGRLEKIHPTGKMFILSDGEGKNGTIELMEPLDEEISGIVEVVGRVTAKATILCTSYVQFKEDSHPFDLGLYNEAVKIIHDFPQFYPLGIVQHD

SEQ ID NO: 183 - protein, 307 aa, Artificial Sequence
  Synthetic
MAEISDLDRQIEQLRRCELIKESEVKALCAKAREILVEESNVQRVDSPVTVCGDIHGQFYDLKELFRVGGDVPETNYLFMGDFVDRGFYSVETFLLLLALKVRYPDRITLIRGNHESRQITQVYGFYDECLRKYGSVTVWRYCTEIFDYLSLSAIIDGKIFCVHGGLSPSIQTLDQIRTIDRKQEVPHDGPMCDLLWSDPEDTTGWGVSPRGAGYLFGSDVVAQFNAANDIDMICRAHQLVMEGYKWHFNETVLTVWSAPNYCYRCGNVAAILELDEHLQKDFIIFEAAPQETRGIPSKKPVADYFL

SEQ ID NO: 184 - protein, 339 aa, Homo sapiens
MAMQMQLEANADTSVEEESFGPQPISRLEQCGINANDVKKLEEAGFHTVEAVAYAPKKELINIKGISEAKADKILAEAAKLVPMGFTTATEFHQRRSEIIQITTGSKELDKLLQGGIETGSITEMFGEFRTGKTQICHTLAVTCQLPIDRGGGEGKAMYIDTEGTFRPERLLAVAERYGLSGSDVLDNVAYARAFNTDHQTQLLYQASAMMVESRYALLIVDSATALYRTDYSGRGELSARQMHLARFLRMLLRLADEFGVAVVITNQVVAQVDGAAMFAADPKKPIGGNIIAHASTTRLYLRKGRGETRICKIYDSPCLPEAEAMFAINADGVGDAKD

SEQ ID NO: 185 - protein, 340 aa, Homo sapiens
MAMQMQLEANADTSVEEESFGPQPISRLEQCGINANDVKKLEEAGFHTVEAVAYAPKKELINIKGISEAKADKILTESRSVARLECNSVILVYCTLRLSGSSDSPASASRVVGTTGGIETGSITEMFGEFRTGKTQICHTLAVTCQLPIDRGGGEGKAMYIDTEGTFRPERLLAVAERYGLSGSDVLDNVAYARAFNTDHQTQLLYQASAMMVESRYALLIVDSATALYRTDYSGRGELSARQMHLARFLRMLLRLADEFGVAVVITNQVVAQVDGAAMFAADPKKPIGGNIIAHASTTRLYLRKGRGETRICKIYDSPCLPEAEAMFAINADGVGDAKD

SEQ ID NO: 186 - protein, 280 aa, Artificial Sequence
  Synthetic
MAMQMQLEANADTSVEEESFGPQPISRLEQCGINANDVKKLEEAGFHTVEAVAYAPKKELINIKGISEAKADKILAEAAKLVPMGFTTATEFHQRRSEIIQITTGSKELDKLLQGGIETGSITEMFGEFRTGKTQICHTLAVTCQLPIDRGGGEGKAMYIDTEGTFRPERLLAVAERYGLSGSDVLDNVAYARAFNTDHQTQLLYQASAMMVESRYALLIVDSATALYRTDYSGRGELSARQMHLARFLRMLLRLADEIVSEERKRGNQNLQNLRLSLSS

SEQ ID NO: 187 - protein, 736 aa, Homo sapiens
MSLSENSVFAYESSVHSTNVLLSLNDQRKKDVLCDVTIFVEGQRFRAHRSVLAACSSYFHSRIVGQADGELNITLPEEVTVKGFEPLIQFAYTAKLILSKENVDEVCKCVEFLSVHNIEESCFQFLKFKFLDSTADQQECPRKKCFSSHCQKTDLKLSLLDQRDLETDEVEEFLENKNVQTPQCKLRRYQGNAKASPPLQDSASQTYESMCLEKDAALALPSLCPKYRKFQKAFGTDRVRTGESSVKDIHASVQPNERSENECLGGVPECRDLQVMLKCDESKLAMEPEETKKDPASQCPTEKSEVTPFPHNSSIDPHGLYSLSLLHTYDQYGDLNFAGMQNTTVLTEKPLSGTDVQEKTFGESQDLPLKSDLGTREDSSVASSDRSSVEREVAEHLAKGFWSDICSTDTPCQMQLSPAVAKDGSEQISQKRSECPWLGIRISESPEPGQRTFTTLSSVNCPFISTLSTEGCSSNLEIGNDDYVSEPQQEPCPYACVISLGDDSETDTEGDSESCSAREQECEVKLPFNAQRIISLSRNDFQSLLKMHKLTPEQLDCIHDIRRRSKNRIAAQRCRKRKLDCIQNLESEIEKLQSEKESLLKERDHILSTLGETKQNLTGLCQKVCKEAALSQEQIQILAKYSAADCPLSFLISEKDKSTPDGELALPSIFSLSDRPPAVLPPCARGNSEPGYARGQESQQMSTATSEQAGPAEQCRQSGGISDFCQQMTDKCTTDE

SEQ ID NO: 188 - protein, 1249 aa, Artificial Sequence
  Synthetic
MSSMWSEYTIGGVKIYFPYKAYPSQLAMMNSILRGLNSKQHCLLESPTGSGKSLALLCSALAWQQSLSGKPADEGVSEKAEVQLSCCCACHSKDFTNNDMNQGTSRHFNYPSTPPSERNGTSSTCQDSPEKTTLAAKLSAKKQASIYRDENDDFQVEKKRIRPLETTQQIRKRHCFGTEVHNLDAKVDSGKTVKLNSPLEKINSFSPQKPPGHCSRCCCSTKQGNSQESSNTIKKDHTGKSKIPKIYFGTRTHKQIAQITRELRRTAYSGVPMTILSSRDHTCVHPEVVGNFNRNEKCMELLDGKNGKSCYFYHGVHKISDQHTLQTFQGMCKAWDIEELVSLGKKLKACPYYTARELIQDADIIFCPYNYLLDAQIRESMDLNLKEQVVILDEAHNIEDCARESASYSVTEVQLRFARDELDSMVNNNIRKKDHEPLRAVCCSLINWLEANAEYLVERDYESACKIWSGNEMLLTLHKMGITTATFPILQGHFSAVLQKEEKISPIYGKEEAREVPVISASTQIMLKGLFMVLDYLFRQNSRFADDYKIAIQQTYSWTNQIDISDKNGLLVLPKNKKRSRQKTAVHVLNFWCLNPAVAFSDINGKVQTIVLTSGTLSPMKSFSSELGVTFTIQLEANHIIKNSQVWVGTIGSGPKGRNLCATFQNTETFEFQDEVGALLLSVCQTVSQGILCFLPSYKLLEKLKERWLSTGLWHNLELVKTVIVEPQGGEKTNFDELLQVYYDAIKYKGEKDGALLVAVCRGKVSEGLDFSDDNARAVITIGIPFPNVKDLQVELKRQYNDHHSKLRGLLPGRQWYEIQAYRALNQALGRCIRHRNDWGALILVDDRFRNNPSRYISGLSKWVRQQIQHHSTFESALESLAEFSKKHQKVLNVSIKDRTNIQDNESTLEVTSLKYSTSPYLLEAASHLSPENFVEDEAKICVQELQCPKIITKNSPLPSSIISRKEKNDPVFLEEAGKAEKIVISRSTSPTFNKQTKRVSWSSFNSLGQYFTGKIPKATPELGSSENSASSPPRFKTEKMESKTVLPFTDKCESSNLTVNTSFGSCPQSETIISSLKIDATLTRKNHSEHPLCSEEALDPDIELSLVSEEDKQSTSNRDFETEAEDESIYFTPELYDPEDTDEEKNDLAETDRGNRLANNSDCILAKDLFEIRTIKEVDSAREVKAEDCIDTKLNGILHIEESKIDDIDGNVKTTWINELELGKTHEIEIKNFKPSPSKNKGMFPGFK

SEQ ID NO: 189 - protein, 1522 aa, Artificial Sequence
  Synthetic
MSRNDKEPFFVKFLKSSDNSKCFFKALESIKEFQSEEYLQIITEEEALKIKENDRSLYICDPFSGVVFDHLKKLGCRIVGPQVVIFCMHHQRCVPRAEHPVYNMVMSDVTISCTSLEKEKREEVHKYVQMMGGRVYRDLNVSVTHLIAGEVGSKKYLVAANLKKPILLPSWIKTLWEKSQEKKITRYTDINMEDFKCPIFLGCIICVTGLCGLDRKEVQQLTVKHGGQYMGQLKMNECTHLIVQEPKGQKYECAKRWNVHCVTTQWFFDSIEKGFCQDESIYKTEPRPEAKTMPNSSTPTSQINTIDSRTLSDVSNISNINASCVSESICNSLNSKLEPTLENLENLDVSAFQAPEDLLDGCRIYLCGFSGRKLDKLRRLINSGGGVRFNQLNEDVTHVIVGDYDDELKQFWNKSAHRPHVVGAKWLLECFSKGYMLSEEPYIHANYQPVEIPVSHKPESKAALLKKKNSSFSKKDFAPSEKHEQADEDLLSQYENGSSTVVEAKTSEARPFNDSTHAEPLNDSTHISLQEENQSSVSHCVPDVSTITEEGLFSQKSFLVLGFSNENESNIANIIKENAGKIMSLLSRTVADYAVVPLLGCEVEATVGEVVTNTWLVTCIDYQTLFDPKSNPLFTPVPVMTGMTPLEDCVISFSQCAGAEKESLTFLANLLGASVQEYFVRKSNAKKGMFASTHLILKERGGSKYEAAKKWNLPAVTIAWLLETARTGKRADESHFLIENSTKEERSLETEITNGINLNSDTAEHPGTRLQTHRKTVVTPLDMNRFQSKAFRAVVSQHARQVAASPAVGQPLQKEPSLHLDTPSKFLSKDKLFKPSFDVKDALAALETPGRPSQQKRKPSTPLSEVIVKNLQLALANSSRNAVALSASPQLKEAQSEKEEAPKPLHKVVVCVSKKLSKKQSELNGIAASLGADYRWSFDETVTHFIYQGRPNDTNREYKSVKERGVHIVSEHWLLDCAQECKHLPESLYPHTYNPKMSLDISAVQDGRLCNSRLLSAVSSTKDDEPDPLILEENDVDNMATNNKESAPSNGSGKNDSKGVLTQTLEMRENFQKQLQEIMSATSIVKPQGQRTSLSRSGCNSASSTPDSTRSARSGRSRVLEALRQSRQTVPDVNTEPSQNEQIIWDDPTAREERARLASNLQWPSCPTQYSELQVDIQNLEDSPFQKPLHDSEIAKQAVCDPGNIRVTEAPKHPISEELETPIKDSHLIPTPQAPSIAFPLANPPVAPHPREKIITIEETHEELKKQYIFQLSSLNPQERIDYCHLIEKLGGLVIEKQCFDPTCTHIVVGHPLRNEKYLASVAAGKWVLHRSYLEACRTAGHFVQEEDYEWGSSSILDVLTGINVQQRRLALAAMRWRKKIQQRQESGIVEGAFSGWKVILHVDQSREAGFKRLLQSGGAKVLPGHSVPLFKEATHLFSDLNKLKPDDSGVNIAEAAAQNVYCLRTEYIADYLMQESPPHVENYCLPEAISFIQNNKELGTGLSQKRKAPTEKNKIKRPRVH

SEQ ID NO: 190 - protein, 1001 aa, Homo sapiens
MIFPVARYALRWLRRPEDRAFSRAAMEMALRGVRKVLCVAEKNDAAKGIADLLSNGRMRRREGLSKFNKIYEFDYHLYGQNVTMVMTSVSGHLLAHDFQMQFRKWQSCNPLVLFEAEIEKYCPENFVDIKKTLERETRQCQALVIWTDCDREGENIGFEIIHVCKAVKPNLQVLRARFSEITPHAVRTACENLTEPDQRVSDAVDVRQELDLRIGAAFTRFQTLRLQRIFPEVLAEQLISYGSCQFPTLGFVVERFKAIQAFVPEIFHRIKVTHDHKDGIVEFNWKRHRLFNHTACLVLYQLCVEDPMATVVEVRSKPKSKWRPQALDTVELEKLASRKLRINAKETMRIAEKLYTQGYISYPRTETNIFPRDLNLTVLVEQQTPDPRWGAFAQSILERGGPTPRNGNKSDQAHPPIHPTKYTNNLQGDEQRLYEFIVRHFLACCSQDAQGQETTVEIDIAQERFVAHGLMILARNYLDVYPYDHWSDKILPVYEQGSHFQPSTVEMVDGETSPPKLLTEADLIALMEKHGIGTDATHAEHIETIKARMYVGLTPDKRFLPGHLGMGLVEGYDSMGYEMSKPDLRAELEADLKLICDGKKDKFVVLRQQVQKYKQVFIEAVAKAKKLDEALAQYFGNGTELAQQEDIYPAMPEPIRKCPQCNKDMVLKTKKNGGFYLSCMGFPECRSAVWLPDSVLEASRDSSVCPVCQPHPVYRLKLKFKRGSLPPTMPLEFVCCIGGCDDTLREILDLRFSGGPPRASQPSGRLQANQSLNRMDNSQHPQPADSRQTGSSKALAQTLPPPTAAGESNSVTCNCGQEAVLLTVRKEGPNRGRQFFKCNGGSCNFFLWADSPNPGAGGPPALAYRPLGASLGCPPGPGIHLGGFGNPGDGSGSGTSCLCSQPSVTRTVQKDGPNKGRQFHTCAKPREQQCGFFQWVDENTAPGTSGAPSWTGDRGRTLESEARSKRPRASSSDMGSTAKKPRKCSLCHQPGHTRPFCPQNR

SEQ ID NO: 191 - protein, 380 aa, Artificial Sequence
  Synthetic
MGIQGLAKLIADVAPSAIRENDIKSYFGRKVAIDASMSIYQFLIAVRQGGDVLQNEEGETTSHLMGMFYRTIRMMENGIKPVYVFDGKPPQLKSGELAKRSERRAEAEKQLQQAQAAGAEQEVEKFTKRLVKVTKQHNDECKHLLSLMGIPYLDAPSEAEASCAALVKAGKVYAAATEDMDCLTFGSPVLMRHLTASEAKKLPIQEFHLSRILQELGLNQEQFVDLCILLGSDYCESIRGIGPKRAVDLIQKHKSIEEIVRRLDPNKYPVPENWLHKEAHQLFLEPEVLDPESVELKWSEPNEEELIKFMCGEKQFSEERIRSGVKRLSKSRQGSTQGRLDDFFKVTGSLSSAKRKEPEPKGSTKKKAKTGAAGKFKRGK

SEQ ID NO: 192 - protein, 551 aa, Homo sapiens
MAAPVRLGRKRPLPACPNPLFVRWLTEWRDEATRSRRRTRFVFQKALRSLRRYPLPLRSGKEAKILQHFGDGLCRMLDERLQRHRTSGGDHAPDSPSGENSPAPQGRLAEVQDSSMPVPAQPKAGGSGSYWPARHSGARVILLVLYREHLNPNGHHFLTKEELLQRCAQKSPRVAPGSARPWPALRSLLHRNLVLRTHQPARYSLTPEGLELAQKLAESEGLSLLNVGIGPKEPPGEETAVPGAASAELASEAGVQQQPLELRPGEYRVLLCVDIGETRGGGHRPELLRELQRLHVTHTVRKLHVGDFVWVAQETNPRDPANPGELVLDHIVERKRLDDLCSSIIDGRFREQKFRLKRCGLERRVYLVEEHGSVHNLSLPESTLLQAVTNTQVIDGFFVKRTADIKESAAYLALLTRGLQRLYQGHTLRSRPWGTPGNPESGAMTSPNPLCSLLTFSDFNAGAIKNKAQSVREVFARQLMQVRGVSGEKAAALVDRYSTPASLLAAYDACATPKEQETLLSTIKCGRLQRNLGPALSRTLSQLYCSYGPLT

SEQ ID NO: 193 - protein, 583 aa, Homo sapiens
MALKKSSPSLDSGDSDSEELPTFAFLKKEPSSTKRRQPEREEKIVVVDISDCEASCPPAPELFSPPVPEIAETVTQTQPVRLLSSESEDEEEFIPLAQRLTCKFLTHKQLSPEDSSSPVKSVLDHQNNEGASCDWKKPFPKIPEVPLHDTPERSAADNKDLILDPCCQLPAYLSTCPGQSSSLAVTKTNSDILPPQKKTKPSQKVQGRGSHGCRQQRQARQKESTLRRQERKNAALVTRMKAQRPEECLKHIIVVLDPVLLQMEGGGQLLGALQTMECRCVIEAQAVPCSVTWRRRAGPSEDREDWVEEPTVLVLLRAEAFVSMIDNGKQGSLDSTMKGKETLQGFVTDITAKTAGKALSLVIVDQEKCFSLELLFFDFLPCTSAQNPPRRGKQGANKQTKKQQQRQPEASIGSMVSRVDAEEALVDLQLHTEAQAQIVQSWKELADFTCAFTKAVAEAPFKKLRDETTFSFCLESDWAGGVKVDLAGRGLALVWRRQIQQLNRVSLEMASAVVNAYPSPQLLVQAYQQCFSDKERQNLLADIQVRRGEGVTSTSRRIGPELSRRIYLQMTTLQPHLSLDSAD

SEQ ID NO: 194 - protein, 570 aa, Homo sapiens
MALKKSSPSLDSGDSDSEELPTFAFLKKEPSSTKRRQPEREEKIVVVDISDCEASCPPAPELFSPPVPEIAETVTQTQPVRLLSSESEDEEEFIPLAQRLTCKFLTHKQLSPEDSSSPVKSVLDHQNNEGASCDWKKPFPKIPEVPLHDTPERSAADNKDLILDPCCQLPAYLSTCPGQSSSLAVTKTNSDILPPQKKTKPSQKVQGRGSHGCRQQRQARQKESTLRRQERKNAALVTRMKAQRPEECLKHIIVVLDPVLLQMEGGGQLLGALQTMECRCVIEAQAVPCSVTWRRRAGPSEDREDWVEEPTVLVLLRAEAFVSMIDNGKQGSLDSTMKGKETLQGFVTDITAKTAGKALSLVIVDQEKCFSAQNPPRRGKQGANKQTKKQQQRQPEASIGSMVSRVDAEEALVDLQLHTEAQAQIVQSWKELADFTCAFTKAVAEAPFKKLRDETTFSFCLESDWAGGVKVDLAGRGLALVWRRQIQQLNRVSLEMASAVVNAYPSPQLLVQAYQQCFSDKERQNLLADIQVRRGEGVTSTSRRIGPELSRRIYLQMTTLQPHLSLDSAD

SEQ ID NO: 195 - protein, 275 aa, Homo sapiens
MGPAGVAARPGRFFGVYLLYCLNPRYRGRVYVGFTVNTARRVQQHNGGRKKGGAWRTSGRGPWEMVLVVHGFPSSVAALRFEWAWQHPHASRRLAHVGPRLRGETAFAFHLRVLAHMLRAPPWARLPLTLRWVRPDLRQDLCLPPPPHVPLAFGPPPPQAPAPRRRAGPFDDAEPEPDQGDPGACCSLCAQTIQDEEGPLCCPHPGCLLRAHVICLAEEFLQEEPGQLLPLEGQCPCCEKSLLWGDLIWLCQMDTEKEVEDSELEEAHWTDLLET

SEQ ID NO: 196 - protein, 161 aa, Homo sapiens
MGPAGVAARPGRFFGVYLLYCLNPRYRGRVYVGFTVNTARRVQQHNGGRKKGGAWRTSGRGPWEMVLVVHGFPSSVAALRDEEGPLCCPHPGCLLRAHVICLAEEFLQEEPGQLLPLEGQCPCCEKSLLWGDLIWLCQMDTEKEVEDSELEEAHWTDLLET

SEQ ID NO: 197 - protein, 1834 aa, Homo sapiens
MKLSVNEAQLGFYLGSLSHLSACPGIDPRSSEDQPESLKTGQMMDESDEDFKELCASFFQRVKKHGIKEVSGERKTQKAASNGTQIRSKLKRTKQTATKTKTLQGPAEKKPPSGSQAPRTKKQRVTKWQASEPAHSVNGEGGVLASAPDPPVLRETAQNTQTGNQQEPSPNLSREKTRENVPNSDSQPPPSCLTTAVPSPSKPRTAQLVLQRMQQFKRADPERLRHASEECSLEAAREENVPKDPQEEMMAGNVYGLGPPAPESDAAVALTLQQEFARVGASAHDDSLEEKGLFFCQICQKNLSAMNVTRREQHVNRCLDEAEKTLRPSVPQIPECPICGKPFLTLKSRTSHLKQCAVKMEVGPQLLLQAVRLQTAQPEGSSSPPMFSFSDHSRGLKRRGPTSKKEPRKRRKVDEAPSEDLLVAMALSRSEMEPGAAVPALRLESAFSERIRPEAENKSRKKKPPVSPPLLLVQDSETTGRQIEDRVALLLSEEVELSSTPPLPASRILKEGWERAGQCPPPPERKQSFLWEGSALTGAWAMEDFYTARLVPPLVPQRPAQGLMQEPVPPLVPPEHSELSERRSPALHGTPTAGCGSRGPSPSASQREHQALQDLVDLAREGLSASPWPGSGGLAGSEGTAGLDVVPGGLPLTGFVVPSQDKHPDRGGRTLLSLGLLVADFGAMVNNPHLSDVQFQTDSGEVLYAHKFVLYARCPLLIQYVNNEGFSAVEDGVLTQRVLLGDVSTEAARTFLHYLYTADTGLPPGLSSELSSLAHRFGVSELVHLCEQVPIATDSEGKPWEEKEAENCESRAENFQELLRSMWADEEEEAETLLKSKDHEEDQENVNEAEMEEIYEFAATQRKLLQEERAAGAGEDADWLEGGSPVSGQLLAGVQVQKQWDKVEEMEPLEPGRDEAATTWEKMGQCALPPPQGQHSGARGAEAPEQEAPEEALGHSSCSSPSRDCQAERKEGSLPHSDDAGDYEQLFSSTQGEISEPSQITSEPEEQSGAVRERGLEVSHRLAPWQASPPHPCRFLLGPPQGGSPRGSHHTSGSSLSTPRSRGGTSQVGSPTLLSPAVPSKQKRDRSILTLSKEPGHQKGKERRSVLECRNKGVLMFPEKSPSIDLTQSNPDHSSSRSQKSSSKLNEEDEVILLLDSDEELELEQTKMKSISSDPLEEKKALEISPRSCELFSIIDVDADQEPSQSPPRSEAVLQQEDEGALPENRGSLGRRGAPWLFCDRESSPSEASTTDTSWLVPATPLASRSRDCSSQTQISSLRSGLAVQAVTQHTPRASVGNREGNEVAQKFSVIRPQTPPPQTPSSCLTPVSPGTSDGRRQGHRSPSRPHPGGHPHSSPLAPHPISGDRAHFSRRFLKHSPPGPSFLNQTPAGEVVEVGDSDDEQEVASHQANRSPPLDSDPPIPIDDCCWHMEPLSPIPIDHWNLERTGPLSTSSPSRRMNEAADSRDCRSPGLLDTTPIRGSCTTQRKLQEKSSGAGSLGNSRPSFLNSALWDVWDGEEQRPPETPPPAQMPSAGGAQKPEGLETPKGANRKKNLPPKVPITPMPQYSIMETPVLKKELDRFGVRPLPKRQMVLKLKEIFQYTHQTLDSDSEDESQSSQPLLQAPHCQTLASQTYKPSRAGVHAQQEATTGPGAHRPKGPAKTKGPRHQRKHHESITPPSRSPTKEAPPGLNDDAQIPASQESVATSVDGSDSSLSSQSSSSCEFGAAFESAGEEEGEGEVSASQAAVQAADTDEALRCYIRSKPALYQKVLLYQPFELRELQAELRQNGLRVSSRRLLDFLDTHCITFTTAATRREKLQGRRRQPRGKKKVERN

SEQ ID NO: 198 - RNA, 19 nt, Artificial Sequence
  Synthetic
cagcuacccuuccaucaua

SEQ ID NO: 199 - RNA, 19 nt, Artificial Sequence
  Synthetic
gggauaccaugcaacauaa

SEQ ID NO: 200 - RNA, 19 nt, Artificial Sequence
  Synthetic
gaaggagcuuucaucauuc

SEQ ID NO: 201 - protein, 48 aa, Artificial Sequence
  Synthetic
  misc_feature (13)..(48): "GSAGSAAGSGEF" may or may not be present
GSAGSAAGSGEFGSAGSAAGSGEFGSAGSAAGSGEFGSAGSAAGSGEF

SEQ ID NO: 202 - protein, 48 aa, Artificial Sequence
  Synthetic
  misc_feature (13)..(48): "SIVAQLSRPDPA" may or may not be present
SIVAQLSRPDPASIVAQLSRPDPASIVAQLSRPDPASIVAQLSRPDPA

SEQ ID NO: 203 - RNA, 19 nt, Artificial Sequence
  Synthetic
cuagaaaucuguugcuaug

SEQ ID NO: 204 - RNA, 21 nt, Artificial Sequence
  Synthetic
uucuuuaauagacugggucac

SEQ ID NO: 205 - DNA, 21 bp, Artificial Sequence
  Synthetic
uaugauggaaggguagcugtt

SEQ ID NO: 206 - DNA, 21 bp, Artificial Sequence
  Synthetic
uaucagguuauguugcauggt

SEQ ID NO: 207 - RNA, 19 nt, Artificial Sequence
  Synthetic
gaaacggacuugcuauuua

SEQ ID NO: 208 - RNA, 19 nt, Artificial Sequence
  Synthetic
guaaagaaaugcagaauuc

SEQ ID NO: 209 - RNA, 19 nt, Artificial Sequence
  Synthetic
gguaucagaugcuucauua

SEQ ID NO: 210 - RNA, 19 nt, Artificial Sequence
  Synthetic
gaagaaugcagguuuaaua

SEQ ID NO: 211 - DNA, 21 bp, Artificial Sequence
  Synthetic
uuccguuuaauuucaacugta

SEQ ID NO: 212 - RNA, 21 nt, Artificial Sequence
  Synthetic
uugcgaaauauguauaaucca

SEQ ID NO: 213 - DNA, 21 bp, Artificial Sequence
  Synthetic
uacguuuuuaggugaagcctg

SEQ ID NO: 214 - RNA, 19 nt, Artificial Sequence
  Synthetic
gcagugauguccuggauaa

SEQ ID NO: 215 - RNA, 19 nt, Artificial Sequence
  Synthetic
ccaacgaugugaagaaauu

SEQ ID NO: 216 - RNA, 19 nt, Artificial Sequence
  Synthetic
aagcuauguucgccauuaa

SEQ ID NO: 217 - DNA, 21 bp, Artificial Sequence
  Synthetic
ugcauaccuagauucuaccat

SEQ ID NO: 218 - DNA, 21 bp, Artificial Sequence
  Synthetic
ugauuagugauuaccacugct

SEQ ID NO: 219 - DNA, 21 bp, Artificial Sequence
  Synthetic
ugcuugauaaaggagcugggt

SEQ ID NO: 220 - protein, 1043 aa, Homo sapiens
MRRFKRKHLTAIDCQHLARSHLAVTQPFGQRWTNRDPNHGLYPKPRTKRGSRGQGSQRCIPEFFLAGKQPCTNDMAKSNSVGQDSCQDSEGDMIFPAESSCALPQEGSAGPGSPGSAPPSRKRSWSSEEESNQATGTSRWDGVSKKAPRHHLSVPCTRPREARQEAEDSTSRLSAESGETDQDAGDVGPDPIPDSYYGLLGTLPCQEALSHICSLPSEVLRHVFAFLPVEDLYWNLSLVCHLWREIISDPLFIPWKKLYHRYLMNEEQAVSKVDGILSNCGIEKESDLCVLNLIRYTATTKCSPSVDPERVLWSLRDHPLLPEAEACVRQHLPDLYAAAGGVNIWALVAAVVLLSSSVNDIQRLLFCLRRPSSTVTMPDVTETLYCIAVLLYAMREKGINISNRIHYNIFYCLYLQENSCTQATKVKEEPSVWPGKKTIQLTHEQQLILNHKMEPLQVVKIMAFAGTGKTSTLVKYAEKWSQSRFLYVTFNKSIAKQAERVFPSNVICKTFHSMAYGHIGRKYQSKKKLNLFKLTPFMVNSVLAEGKGGFIRAKLVCKTLENFFASADEELTIDHVPIWCKNSQGQRVMVEQSEKLNGVLEASRLWDNMRKLGECTEEAHQMTHDGYLKLWQLSKPSLASFDAIFVDEAQDCTPAIMNIVLSQPCGKIFVGDPHQQIYTFRGAVNALFTVPHTHVFYLTQSFRFGVEIAYVGATILDVCKRVRKKTLVGGNHQSGIRGDAKGQVALLSRTNANVFDEAVRVTEGEFPSRIHLIGGIKSFGLDRIIDIWILLQPEEERRKQNLVIKDKFIRRWVHKEGFSGFKRYVTAAEDKELEAKIAVVEKYNIRIPELVQRIEKCHIEDLDFAEYILGTVHKAKGLEFDTVHVLDDFVKVPCARHNLPQLPHFRVESFSEDEWNLLYVAVTRAKKRLIMTKSLENILTLAGEYFLQAELTSNVLKTGVVRCCVGQCNNAIPVDTVLTMKKLPITYSNRKENKGGYLCHSCAEQRIGPLAFLTASPEQVRAMERTVENIVLPRHEALLFLVF

SEQ ID NO: 221 - protein, 579 aa, Homo sapiens
MAVFNQKSVSDMIKEFRKNWRALCNSERTTLCGADSMLLALQLSMAENNKQHSGEFTVSLSDVLLTWKYLLHEKLNLPVENMDVTDHYEDVRKIYDDFLKNSNMLDLIDVYQKCRALTSNCENYNTVSPSQLLDFLSGKQYAVGDETDLSIPTSPTSKYNRDNEKVQLLARKIIFSYLNLLVNSKNDLAVAYILNIPDRGLGREAFTDLKHAAREKQMSIFLVATSFIRTIELGGKGYAPPPSDPLRTHVKGLSNFINFIDKLDEILGEIPNPSIAGGQILSVIKMQLIKGQNSRDPFCKAIEEVAQDLDLRIKNIINSQEGVVALSTTDISPARPKSHAINHGTAYCGRDTVKALLVLLDEEAANAPTKNKAELLYDEENTIHHHGTSILTLFRSPTQVNNSIKPLRERICVSMQEKKIKMKQTLIRSQFACTYKDDYMISKDNWNNVNLASKPLCVLYMENDLSEGVNPSVGRSTIGTSFGNVHLDRSKNEKVSRKSTSQTGNKSSKRKQVDLDGENILCDNRNEPPQHKNAKIPKKSNDSQNRLYGKLAKVAKSNKCTAKDKLISGQAKLTQFFRL

SEQ ID NO: 222 - protein, 579 aa, Homo sapiens; identical to SEQ ID NO: 221

SEQ ID NO: 223 - protein, 498 aa, Homo sapiens
MDVTDHYEDVRKIYDDFLKNSNMLDLIDVYQKCRALTSNCENYNTVSPSQLLDFLSGKQYAVGDETDLSIPTSPTSKYNRDNEKVQLLARKIIFSYLNLLVNSKNDLAVAYILNIPDRGLGREAFTDLKHAAREKQMSIFLVATSFIRTIELGGKGYAPPPSDPLRTHVKGLSNFINFIDKLDEILGEIPNPSIAGGQILSVIKMQLIKGQNSRDPFCKAIEEVAQDLDLRIKNIINSQEGVVALSTTDISPARPKSHAINHGTAYCGRDTVKALLVLLDEEAANAPTKNKAELLYDEENTIHHHGTSILTLFRSPTQVNNSIKPLRERICVSMQEKKIKMKQTLIRSQFACTYKDDYMISKDNWNNVNLASKPLCVLYMENDLSEGVNPSVGRSTIGTSFGNVHLDRSKNEKVSRKSTSQTGNKSSKRKQVDLDGENILCDNRNEPPQHKNAKIPKKSNDSQNRLYGKLAKVAKSNKCTAKDKLISGQAKLTQFFRL

SEQ ID NO: 224 - protein, 172 aa, Homo sapiens
MAVFNQKSVSDMIKEFRKNWRALCNSERTTLCGADSMLLALQLSMAENNKQHSGEFTVSLSDVLLTWKYLLHEKLNLPVENMDVTDHYEDVRKIYDDFLKNSNMLDLIDVYQKCRALTSNCENYNTVSPSQLLDFLSGKQYAVGDETDLSIPTSPTSKYNRDNEKALPVLKR

SEQ ID NO: 225 - protein, 133 aa, Homo sapiens
MAVFNQKSVSDMIKEFRKNWRALCNSERTTLCGADSMLLALQLSMAENNKQHSGEFTVSLSDVLLTWKYLLHEKLNLPVENMDVTDHYEDVRKIYDDFLKNSNMLDLIDVYQKCRALTSNCENYNTVSPVSIF

SEQ ID NO: 226 - protein, 294 aa, Homo sapiens
MQLIKGQNSRDPFCKAIEEVAQDLDLRIKNIINSQEGVVALSTTDISPARPKSHAINHGTAYCGRDTVKALLVLLDEEAANAPTKNKAELLYDEENTIHHHGTSILTLFRSPTQVNNSIKPLRERICVSMQEKKIKMKQTLIRSQFACTYKDDYMISKDNWNNVNLASKPLCVLYMENDLSEGVNPSVGRSTIGTSFGNVHLDRSKNEKVSRKSTSQTGNKSSKRKQVDLDGENILCDNRNEPPQHKNAKIPKKSNDSQNRLYGKLAKVAKSNKCTAKDKLISGQAKLTQFFRL

SEQ ID NO: 227 - protein, 297 aa, Homo sapiens
MAVFNQKSVSDMIKEFRKNWRALCNSERTTLCGADSMLLALQLSMAENNKQHSGEFTVSLSDVLLTWKYLLHEKLNLPVENMDVTDHYEDVRKIYDDFLKNSNMLDLIDVYQKCRALTSNCENYNTVSPSQLLDFLSGKQYAVGDETDLSIPTSPTSKYNRDNEKVQLLARKIIFSYLNLLVNSKNDLAVAYILNIPDRGLGREAFTDLKHAAREKQMSIFLVATSFIRTIELGGKGYAPPPSDPLRTHVKGLSNFINFIDKLDEILGEIPNPRGCKSICWKINNWNEFWKCSSGQK

SEQ ID NO: 228 - protein, 302 aa, Homo sapiens
MAVFNQKSVSDMIKEFRKNWRALCNSERTTLCGADSMLLALQLSMAENNKQHSGEFTVSLSDVLLTWKYLLHEKLNLPVENMDVTDHYEDVRKIYDDFLKNSNMLDLIDVYQKCRALTSNCENYNTVSPSQLLDFLSGKQYAVGDETDLSIPTSPTSKYNRDNEKVQLLARKIIFSYLNLLVNSKNDLAVAYILNIPDRGLGREAFTDLKHAAREKQMSIFLVATSFIRTIELGGKGYAPPPSDPLRTHVKGLSNFINFIDKLDEILGEIPNPRSPTQVNNSIKPLRERICVSMQEKKIKRV

SEQ ID NO: 229 - protein, 1219 aa, Homo sapiens
MPKIVLNGVTVDFPFQPYKCQQEYMTKVLECLQQKVNGILESPTGTGKTLCLLCTTLAWREHLRDGISARKIAERAQGELFPDRALSSWGNAAAAAGDPIACYTDIPKIIYASRTHSQLTQVINELRNTSYRPKVCVLGSREQLCIHPEVKKQESNHLQIHLCRKKVASRSCHFYNNVEEKSLEQELASPILDIEDLVKSGSKHRVCPYYLSRNLKQQADIIFMPYNYLLDAKSRRAHNIDLKGTVVIFDEAHNVEKMCEESASFDLTPHDLASGLDVIDQVLEEQTKAAQQGEPHPEFSADSPSPGLNMELEDIAKLKMILLRLEGAIDAVELPGDDSGVTKPGSYIFELFAEAQITFQTKGCILDSLDQIIQHLAGRAGVFTNTAGLQKLADIIQIVFSVDPSEGSPGSPAGLGALQSYKVHIHPDAGHRRTAQRSDAWSTTAARKRGKVLSYWCFSPGHSMHELVRQGVRSLILTSGTLAPVSSFALEMQIPFPVCLENPHIIDKHQIWVGVVPRGPDGAQLSSAFDRRFSEECLSSLGKALGNIARVVPYGLLIFFPSYPVMEKSLEFWRARDLARKMEALKPLFVEPRSKGSFSETISAYYARVAAPGSTGATFLAVCRGKASEGLDFSDTNGRGVIVTGLPYPPRMDPRVVLKMQFLDEMKGQGGAGGQFLSGQEWYRQQASRAVNQAIGRVIRHRQDYGAVFLCDHRFAFADARAQLPSWVRPHVRVYDNFGHVIRDVAQFFRVAERTMPAPAPRATAPSVRGEDAVSEAKSPGPFFSTRKAKSLDLHVPSLKQRSSGSPAAGDPESSLCVEYEQEPVPARQRPRGLLAALEHSEQRAGSPGEEQAHSCSTLSLLSEKRPAEEPRGGRKKIRLVSHPEEPVAGAQTDRAKLFMVAVKQELSQANFATFTQALQDYKGSDDFAALAACLGPLFAEDPKKHNLLQGFYQFVRPHHKQQFEEVCIQLTGRGCGYRPEHSIPRRQRAQPVLDPTGRTAPDPKLTVSTAAAQQLDPQEHLNQGRPHLSPRPPPTGDPGSQPQWGSGVPRAGKQGQHAVSAYLADARRALGSAGCSQLLAALTAYKQDDDLDKVLAVLAALTTAKPEDFPLLHRFSMFVRPHHKQRFSQTCTDLTGRPYPGMEPPGPQEERLAVPPVLTHRAPQPGPSRSEKTGKTQSKISSFLRQRPAGTVGAGGEDAGPSQSSGPPHGPAASEWGL

SEQ ID NO: 230 - protein, 1243 aa, Homo sapiens
MPKIVLNGVTVDFPFQPYKCQQEYMTKVLECLQQKVNGILESPTGTGKTLCLLCTTLAWREHLRDGISARKIAERAQGELFPDRALSSWGNAAAAAGDPIACYTDIPKIIYASRTHSQLTQVINELRNTSYRSRCRATLWVLETAPPRPTVLSPTRPKVCVLGSREQLCIHPEVKKQESNHLQIHLCRKKVASRSCHFYNNVEEKSLEQELASPILDIEDLVKSGSKHRVCPYYLSRNLKQQADIIFMPYNYLLDAKSRRAHNIDLKGTVVIFDEAHNVEKMCEESASFDLTPHDLASGLDVIDQVLEEQTKAAQQGEPHPEFSADSPSPGLNMELEDIAKLKMILLRLEGAIDAVELPGDDSGVTKPGSYIFELFAEAQITFQTKGCILDSLDQIIQHLAGRAGVFTNTAGLQKLADIIQIVFSVDPSEGSPGSPAGLGALQSYKVHIHPDAGHRRTAQRSDAWSTTAARKRGKVLSYWCFSPGHSMHELVRQGVRSLILTSGTLAPVSSFALEMQIPFPVCLENPHIIDKHQIWVGVVPRGPDGAQLSSAFDRRFSEECLSSLGKALGNIARVVPYGLLIFFPSYPVMEKSLEFWRARDLARKMEALKPLFVEPRSKGSFSETISAYYARVAAPGSTGATFLAVCRGKASEGLDFSDTNGRGVIVTGLPYPPRMDPRVVLKMQFLDEMKGQGGAGGQFLSGQEWYRQQASRAVNQAIGRVIRHRQDYGAVFLCDHRFAFADARAQLPSWVRPHVRVYDNFGHVIRDVAQFFRVAERTMPAPAPRATAPSVRGEDAVSEAKSPGPFFSTRKAKSLDLHVPSLKQRSSGSPAAGDPESSLCVEYEQEPVPARQRPRGLLAALEHSEQRAGSPGEEQAHSCSTLSLLSEKRPAEEPRGGRKKIRLVSHPEEPVAGAQTDRAKLFMVAVKQELSQANFATFTQALQDYKGSDDFAALAACLGPLFAEDPKKHNLLQGFYQFVRPHHKQQFEEVCIQLTGRGCGYRPEHSIPRRQRAQPVLDPTGRTAPDPKLTVSTAAAQQLDPQEHLNQGRPHLSPRPPPTGDPGSQPQWGSGVPRAGKQGQHAVSAYLADARRALGSAGCSQLLAALTAYKQDDDLDKVLAVLAALTTAKPEDFPLLHRFSMFVRPHHKQRFSQTCTDLTGRPYPGMEPPGPQEERLAVPPVLTHRAPQPGPSRSEKTGKTQSKISSFLRQRPAGTVGAGGEDAGPSQSSGPPHGPAASEWGL

SEQ ID NO: 231 - protein, 1300 aa, Homo sapiens
MPKIVLNGVTVDFPFQPYKCQQEYMTKVLECLQQKVNGILESPTGTGKTLCLLCTTLAWREHLRDGISARKIAERAQGELFPDRALSSWGNAAAAAGDPIACYTDIPKIIYASRTHSQLTQVINELRNTSYRPKVCVLGSREQLCIHPEVKKQESNHLQIHLCRKKVASRSCHFYNNVEEKSLEQELASPILDIEDLVKSGSKHRVCPYYLSRNLKQQADIIFMPYNYLLDAKSRRAHNIDLKGTVVIFDEAHNVEKMCEESASFDLTPHDLASGLDVIDQVLEEQTKAAQQGEPHPEFSADSPSPGLNMELEDIAKLKMILLRLEGAIDAVELPGDDSGVTKPGSYIFELFAEAQITFQTKGCILDSLDQIIQHLAGRAGVFTNTAGLQKLADIIQIVFSVDPSEGSPGSPAGLGALQSYKVHIHPDAGHRRTAQRSDAWSTTAARKRGKVLSYWCFSPGHSMHELVRQGVRSLILTSGTLAPVSSFALEMQIPFPVCLENPHIIDKHQIWVGVVPRGPDGAQLSSAFDRRFSEECLSSLGKALGNIARVVPYGLLIFFPSYPVMEKSLEFWRARDLARKMEALKPLFVEPRSKGSFSETISAYYARVAAPGSTGATFLAVCRGKASEGLDFSDTNGRGVIVTGLPYPPRMDPRVVLKMQFLDEMKGQGGAGGQFLSGQEWYRQQASRAVNQAIGRVIRHRQDYGAVFLCDHRFAFADARAQLPSWVRPHVRVYDNFGHVIRDVAQFFRVAERTMPAPAPRATAPSVRGEDAVSEAKSPGPFFSTRKAKSLDLHVPSLKQRSSGSPAAGDPESSLCVEYEQEPVPARQRPRGLLAALEHSEQRAGSPGEEQAHSCSTLSLLSEKRPAEEPRGGRKKIRLVSHPEEPVAGAQTDRAKLFMVAVKQELSQANFATFTQALQDYKGSDDFAALAACLGPLFAEDPKKHNLLQGFYQFVRPHHKQQFEEVCIQLTGRGCGYRPEHSIPRRQRAQPVLDPTGRTAPDPKLTVSTAAAQQLDPQEHLNQGRPHLSPRPPPTGDPGSQPQWGSGVPRAGKQGQHAVSAYLADARRALGSAGCSQLLAALTAYKQDDDLDKVLAVLAALTTAKPEDFPLLHRFSMFVRPHHKQRFSQTCTDLTGRPYPGMEPPGPQEERLAVPPVLTHRAPQPGPSRSEKTGKTQSKISSFLRQRPAGTVGAGGEDAGPSQSSGPPHGPAASEWGEPHGRDIAGQQATGAPGGPLSAGCVCQGCGAEDVVPFQCPACDFQRCQACWQRHLQASRMCPACHTASRKQSVMQVFWPEPQ

SEQ ID NO: 232 - protein, 996 aa, Homo sapiens
MPYNYLLDAKSRRAHNIDLKGTVVIFDEAHNVEKMCEESASFDLTPHDLASGLDVIDQVLEEQTKAAQQGEPHPEFSADSPSPGLNMELEDIAKLKMILLRLEGAIDAVELPGDDSGVTKPGSYIFELFAEAQITFQTKGCILDSLDQIIQHLAGRAGVFTNTAGLQKLADIIQIVFSVDPSEGSPGSPAGLGALQSYKVHIHPDAGHRRTAQRSDAWSTTAARKRGKVLSYWCFSPGHSMHELVRQGVRSLILTSGTLAPVSSFALEMQIPFPVCLENPHIIDKHQIWVGVVPRGPDGAQLSSAFDRRFSEECLSSLGKALGNIARVVPYGLLIFFPSYPVMEKSLEFWRARDLARKMEALKPLFVEPRSKGSFSETISAYYARVAAPGSTGATFLAVCRGKASEGLDFSDTNGRGVIVTGLPYPPRMDPRVVLKMQFLDEMKGQGGAGGQFLSGQEWYRQQASRAVNQAIGRVIRHRQDYGAVFLCDHRFAFADARAQLPSWVRPHVRVYDNFGHVIRDVAQFFRVAERTMPAPAPRATAPSVRGEDAVSEAKSPGPFFSTRKAKSLDLHVPSLKQRSSGSPAAGDPESSLCVEYEQEPVPARQRPRGLLAALEHSEQRAGSPGEEQAHSCSTLSLLSEKRPAEEPRGGRKKIRLVSHPEEPVAGAQTDRAKLFMVAVKQELSQANFATFTQALQDYKGSDDFAALAACLGPLFAEDPKKHNLLQGFYQFVRPHHKQQFEEVCIQLTGRGCGYRPEHSIPRRQRAQPVLDPTGRTAPDPKLTVSTAAAQQLDPQEHLNQGRPHLSPRPPPTGDPGSQPQWGSGVPRAGKQGQHAVSAYLADARRALGSAGCSQLLAALTAYKQDDDLDKVLAVLAALTTAKPEDFPLLHRFSMFVRPHHKQRFSQTCTDLTGRPYPGMEPPGPQEERLAVPPVLTHRAPQPGPSRSEKTGKTQSKISSFLRQRPAGTVGAGGEDAGPSQSSGPPHGPAASEWGL

SEQ ID NO: 233 - protein, 719 aa, Homo sapiens
MPRRKKKVKEVSESRNLEKKDVETTSSVSVKRKRRLEDAFIVISDSDGEEPKEENGLQKTKTKQSNRAKCLAKRKIAQMTEEEQFALALKMSEQEAREVNSQEEEEEELLRKAIAESLNSCRPSDASATRSRPLATGPSSQSHQEKTTDSGLTEGIWQLVPPSLFKGSHISQGNEAEEREEPWDHTEKTEEEPVSGSSGSWDQSSQPVFENVNVKSFDRCTGHSAEHTQCGKPQESTGRGSAFLKAVQGSGDTSRHCLPTLADAKGLQDTGGTVNYFWGIPFCPDGVDPNQYTKVILCQLEVYQKSLKMAQRQLLNKKGFGEPVLPRPPSLIQNECGQGEQASEKNECISEDMGDEDKEERQESRASDWHSKTKDFQESSIKSLKEKLLLEEEPTTSHGQSSQGIVEETSEEGNSVPASQSVAALTSKRSLVLMPESSAEEITVCPETQLSSSETFDLEREVSPGSRDILDGVRIIMADKEVGNKEDAEKEVAISTFSSSNQVSCPLCDQCFPPTKIERHAMYCNGLMEEDTVLTRRQKEAKTKSDSGTAAQTSLDIDKNEKCYLCKSLVPFREYQCHVDSCLQLAKADQGDGPEGSGRACSTVEGKWQQRLKNPKEKGHSEGRLLSFLEQSEHKTSDADIKSSETGAFRVPSPGMEEAGCSREMQSSFTRRDLNESPVKSFVSISEATDCLVDFKKQVTVQPGSRTRTKAGRGRRRKF

SEQ ID NO: 234 - protein, 719 aa, Homo sapiens; identical to SEQ ID NO: 233

SEQ ID NO: 235 - protein, 553 aa, Homo sapiens
MPRRKKKVKEVSESRNLEKKDVETTSSVSVKRKRRLEDAFIVISDSDGEEPKEENGLQKTKTKQSNRAKCLAKRKIAQMTEEEQFALALKMSEQEAREVNSQEEEEEELLRKAIAESLNSCRPSDASATRSRPLATGPSSQSHQEKTTDSGLTEGIWQLVPPSLFKGSHISQGNEAEEREEPWDHTEKTEEEPVSGSSGSWDQSSQPVFENVNVKSFDRCTGHSAEHTQCGKPQSSQGIVEETSEEGNSVPASQSVAALTSKRSLVLMPESSAEEITVCPETQLSSSETFDLEREVSPGSRDILDGVRIIMADKEVGNKEDAEKEVAISTFSSSNQVSCPLCDQCFPPTKIERHAMYCNGLMEEDTVLTRRQKEAKTKSDSGTAAQTSLDIDKNEKCYLCKSLVPFREYQCHVDSCLQLAKADQGDGPEGSGRACSTVEGKWQQRLKNPKEKGHSEGRLLSFLEQSEHKTSDADIKSSETGAFRVPSPGMEEAGCSREMQSSFTRRDLNESPVKSFVSISEATDCLVDFKKQVTVQPGSRTRTKAGRGRRRKF

SEQ ID NO: 236 - protein, 641 aa, Homo sapiens
MTEEEQFALALKMSEQEAREVNSQEEEEEELLRKAIAESLNSCRPSDASATRSRPLATGPSSQSHQEKTTDSGLTEGIWQLVPPSLFKGSHISQGNEAEEREEPWDHTEKTEEEPVSGSSGSWDQSSQPVFENVNVKSFDRCTGHSAEHTQCGKPQESTGRGSAFLKAVQGSGDTSRHCLPTLADAKGLQDTGGTVNYFWGIPFCPDGVDPNQYTKVILCQLEVYQKSLKMAQRQLLNKKGFGEPVLPRPPSLIQNECGQGEQASEKNECISEDMGDEDKEERQESRASDWHSKTKDFQESSIKSLKEKLLLEEEPTTSHGQSSQGIVEETSEEGNSVPASQSVAALTSKRSLVLMPESSAEEITVCPETQLSSSETFDLEREVSPGSRDILDGVRIIMADKEVGNKEDAEKEVAISTFSSSNQVSCPLCDQCFPPTKIERHAMYCNGLMEEDTVLTRRQKEAKTKSDSGTAAQTSLDIDKNEKCYLCKSLVPFREYQCHVDSCLQLAKADQGDGPEGSGRACSTVEGKWQQRLKNPKEKGHSEGRLLSFLEQSEHKTSDADIKSSETGAFRVPSPGMEEAGCSREMQSSFTRRDLNESPVKSFVSISEATDCLVDFKKQVTVQPGSRTRTKAGRGRRRKF

SEQ ID NO: 237 - protein, 349 aa, Homo sapiens
MLPLPDLDLWPLDRLPSPIKRKPQTLGSLKSSQGIVEETSEEGNSVPASQSVAALTSKRSLVLMPESSAEEITVCPETQLSSSETFDLEREVSPGSRDILDGVRIIMADKEVGNKEDAEKEVAISTFSSSNQVSCPLCDQCFPPTKIERHAMYCNGLMEEDTVLTRRQKEAKTKSDSGTAAQTSLDIDKNEKCYLCKSLVPFREYQCHVDSCLQLAKADQGDGPEGSGRACSTVEGKWQQRLKNPKEKGHSEGRLLSFLEQSEHKTSDADIKSSETGAFRVPSPGMEEAGCSREMQSSFTRRDLNESPVKSFVSISEATDCLVDFKKQVTVQPGSRTRTKAGRGRRRKF

SEQ ID NO: 238 - protein, 152 aa, Homo sapiens
MPRRKKKVKEVSESRNLEKKDVETTSSVSVKRKRRLEDAFIVISDSDGEEPKEENGLQKTKTKQSNRAKCLAKRKIAQMTEEEQFALALKMSEQEAREVNSQEEEEEELLRKAIAESLNVNMPCCKSLWRLISYIFDFCGVVVALGTSCSHL

SEQ ID NO: 239 - RNA, 19 nt, Artificial Sequence
  Synthetic
gaaaauggguugcagaaaa

SEQ ID NO: 240 - RNA, 19 nt, Artificial Sequence
  Synthetic
agaggcagcuccuuaauaa

SEQ ID NO: 241 - RNA, 19 nt, Artificial Sequence
  Synthetic
gcacaagacuucagaugca

SEQ ID NO: 242 - RNA, 19 nt, Artificial Sequence
  Synthetic
ggacacaucuaggcacugu

SEQ ID NO: 243 - RNA, 23 nt, Artificial Sequence
  Synthetic
uuaaugcuaaucgugauaggggu

SEQ ID NO: 244 - RNA, 23 nt, Artificial Sequence
  Synthetic
accccuaucacgauuagcauuaa

SEQ ID NO: 245 - RNA, 22 nt, Artificial Sequence
  Synthetic
cuccuacauauuagcauuaaca

SEQ ID NO: 246 - RNA, 22 nt, Artificial Sequence
  Synthetic
uguuaaugcuaauauguaggag

SEQ ID NO: 247 - RNA, 22 nt, Artificial Sequence
  Synthetic
ucaguaaauguuuauuagauga

SEQ ID NO: 248 - RNA, 22 nt, Artificial Sequence
  Synthetic
ucaucuaauaaacauuuacuga

SEQ ID NO: 249 - RNA, 22 nt, Artificial Sequence
  Synthetic
ucagcaaacauuuauugugugc

SEQ ID NO: 250 - RNA, 22 nt, Artificial Sequence
  Synthetic
gcacacaauaaauguuugcuga

SEQ ID NO: 251 - RNA, 23 nt, Artificial Sequence
  Synthetic
agcagcauuguacagggcuauca

SEQ ID NO: 252 - RNA, 23 nt, Artificial Sequence
  Synthetic
ugauagcccuguacaaugcugcu

SEQ ID NO: 253 - RNA, 23 nt, Artificial Sequence
  Synthetic
aggaugagcaaagaaaguagauu

SEQ ID NO: 254 - RNA, 23 nt, Artificial Sequence
  Synthetic
aaucuacuuucuuugcucauccu

SEQ ID NO: 255 - RNA, 22 nt, Artificial Sequence
  Synthetic
cggaugagcaaagaaagugguu

SEQ ID NO: 256 - RNA, 22 nt, Artificial Sequence
  Synthetic
aaccacuuucuuugcucauccg

SEQ ID NO: 257 - RNA, 22 nt, Artificial Sequence
  Synthetic
cggaugagcaaagaaagugguu

SEQ ID NO: 258 - RNA, 22 nt, Artificial Sequence
  Synthetic
aaccacuuucuuugcucauccg

SEQ ID NO: 259 - RNA, 22 nt, Artificial Sequence
  Synthetic
aaaguucugagacacuccgacu

SEQ ID NO: 260 - RNA, 22 nt, Artificial Sequence
  Synthetic
agucggagugucucagaacuuu

SEQ ID NO: 261 - RNA, 22 nt, Artificial Sequence
  Synthetic
ucagugcacuacagaacuuugu

SEQ ID NO: 262 - RNA, 22 nt, Artificial Sequence
  Synthetic
acaaaguucuguagugcacuga

SEQ ID NO: 263 - RNA, 22 nt, Artificial Sequence
  Synthetic
ugggucuuugcgggcgagauga

SEQ ID NO: 264 - RNA, 22 nt, Artificial Sequence
  Synthetic
ucaucucgcccgcaaagaccca

SEQ ID NO: 265 - RNA, 22 nt, Artificial Sequence
  Synthetic
aacuggccuacaaagucccagu

SEQ ID NO: 266 - RNA, 22 nt, Artificial Sequence
  Synthetic
acugggacuuuguaggccaguu

SEQ ID NO: 267 - RNA, 19 nt, Artificial Sequence
  Synthetic
gagcagaccuuucucagua

SEQ ID NO: 268 - RNA, 19 nt, Artificial Sequence
  Synthetic
gaagugaacaagaucauua

SEQ ID NO: 269 - RNA, 19 nt, Artificial Sequence
  Synthetic
caaccaagauguauccuuu

SEQ ID NO: 270 - RNA, 19 nt, Artificial Sequence
  Synthetic
gaauaggacugaguacggu

SEQ ID NO: 271 - RNA, 19 nt, Artificial Sequence
  Synthetic
ggagcuaccucuaguauca

SEQ ID NO: 272 - RNA, 19 nt, Artificial Sequence
  Synthetic
gagguuauauuaaggaaga

SEQ ID NO: 273 - RNA, 19 nt, Artificial Sequence
  Synthetic
gaacagaauaggacugagu

SEQ ID NO: 274 - RNA, 19 nt, Artificial Sequence
  Synthetic
gcacguugcccaaagauuc

SEQ ID NO: 275 - DNA, 21 bp, Artificial Sequence
  Synthetic
uuacuuguaaaccuuguactt

SEQ ID NO: 276 - RNA, 21 nt, Artificial Sequence
  Synthetic
aaaucgaucagacagauccag

SEQ ID NO: 277 - RNA, 21 nt, Artificial Sequence
  Synthetic
ucuuguucacuucagacccaa

SEQ ID NO: 278 - protein, 609 aa, Homo sapiens
MSGWESYYKTEGDEEAEEEQEENLEASGDYKYSGRDSLIFLVDASKAMFESQSEDELTPFDMSIQCIQSVYISKIISSDRDLLAVVFYGTEKDKNSVNFKNIYVLQELDNPGAKRILELDQFKGQQGQKRFQDMMGHGSDYSLSEVLWVCANLFSDVQFKMSHKRIMLFTNEDNPHGNDSAKASRARTKAGDLRDTGIFLDLMHLKKPGGFDISLFYRDIISIAEDEDLRVHFEESSKLEDLLRKVRAKETRKRALSRLKLKLNKDIVISVGIYNLVQKALKPPPIKLYRETNEPVKTKTRTFNTSTGGLLLPSDTKRSQIYGSRQIILEKEETEELKRFDDPGLMLMGFKPLVLLKKHHYLRPSLFVYPEESLVIGSSTLFSALLIKCLEKEVAALCRYTPRRNIPPYFVALVPQEEELDDQKIQVTPPGFQLVFLPFADDKRKMPFTEKIMATPEQVGKMKAIVEKLRFTYRSDSFENPVLQQHFRNLEALALDLMEPEQAVDLTLPKVEAMNKRLGSLVDEFKELVYPPDYNPEGKVTKRKHDNEGSGSKRPKVEYSEEELKTHISKGTLGKFTVPMLKEACRAYGLKSGLKKQELLEALTKHFQD

SEQ ID NO: 279 - protein, 568 aa, Homo sapiens
MSGWESYYKTEGDEEAEEEQEENLEASGDYKYSGRDSLIFLVDASKAMFESQSEDELTPFDMSIQELDNPGAKRILELDQFKGQQGQKRFQDMMGHGSDYSLSEVLWVCANLFSDVQFKMSHKRIMLFTNEDNPHGNDSAKASRARTKAGDLRDTGIFLDLMHLKKPGGFDISLFYRDIISIAEDEDLRVHFEESSKLEDLLRKVRAKETRKRALSRLKLKLNKDIVISVGIYNLVQKALKPPPIKLYRETNEPVKTKTRTFNTSTGGLLLPSDTKRSQIYGSRQIILEKEETEELKRFDDPGLMLMGFKPLVLLKKHHYLRPSLFVYPEESLVIGSSTLFSALLIKCLEKEVAALCRYTPRRNIPPYFVALVPQEEELDDQKIQVTPPGFQLVFLPFADDKRKMPFTEKIMATPEQVGKMKAIVEKLRFTYRSDSFENPVLQQHFRNLEALALDLMEPEQAVDLTLPKVEAMNKRLGSLVDEFKELVYPPDYNPEGKVTKRKHDNEGSGSKRPKVEYSEEELKTHISKGTLGKFTVPMLKEACRAYGLKSGLKKQELLEALTKHFQD

SEQ ID NO: 280 - protein, 732 aa, Homo sapiens
MVRSGNKAAVVLCMDVGFTMSNSIPGIESPFEQAKKVITMFVQRQVFAENKDEIALVLFGTDGTDNPLSGGDQYQNITVHRHLMLPDFDLLEDIESKIQPGSQQADFLDALIVSMDVIQHETIGKKFEKRHIEIFTDLSSRFSKSQLDIIIHSLKKCDISLQFFLPFSLGKEDGSGDRGDGPFRLGGHGPSFPLKGITEQQKEGLEIVKMVMISLEGEDGLDEIYSFSESLRKLCVFKKIERHSIHWPCRLTIGSNLSIRIAAYKSILQERVKKTWTVVDAKTLKKEDIQKETVYCLNDDDETEVLKEDIIQGFRYGSDIVPFSKVDEEQMKYKSEGKCFSVLGFCKSSQVQRRFFMGNQVLKVFAARDDEAAAVALSSLIHALDDLDMVAIVRYAYDKRANPQVGVAFPHIKHNYECLVYVQLPFMEDLRQYMFSSLKNSKKYAPTEAQLNAVDALIDSMSLAKKDEKTDTLEDLFPTTKIPNPRFQRLFQCLLHRALHPREPLPPIQQHIWNMLNPPAEVTTKSQIPLSKIKTLFPLIEAKKKDQVTAQEIFQDNHEDGPTAKKLKTEQGGAHFSVSSLAEGSVTSVGSVNPAENFRVLVKQKKASFEEASNQLINHIEQFLDTNETPYFMKSIDCIRAFREEAIKFSEEQRFNNFLKALQEKVEIKQLNHFWEIVVQDGITLITKEEASGSSVTAEEAKKFLAPKDKPSGDTAAVFEEGGDVDDLLDMI

SEQ ID NO: 281 - protein, 4128 aa, Homo sapiens [sequence omitted]

SEQ ID NO: 282 - protein, 4097 aa, Homo sapiens
MAGSGAGVRCSLLRLQETLSAADRCGAALAGHQLIRGLGQECVLSSSPAVLALQTSLVFSRDFGLLVFVRKSLNSIEFRECREEILKFLCIFLEKMGQKIAPYSVEIKNTCTSVYTKDRAAKCKIPALDLLIKLLQTFRSSRLMDEFKIGELFSKFYGELALKKKIPDTVLEKVYELLGLLGEVHPSEMINNAENLFRAFLGELKTQMTSAVREPKLPVLAGCLKGLSSLLCNFTKSMEEDPQTSREIFNFVLKAIRPQIDLKRYAVPSAGLRLFALHASQFSTCLLDNYVSLFEVLLKWCAHTNVELKKAALSALESFLKQVSNMVAKNAEMHKNKLQYFMEQFYGIIRNVDSNNKELSIAIRGYGLFAGPCKVINAKDVDFMYVELIQRCKQMFLTQTDTGDDRVYQMPSFLQSVASVLLYLDTVPEVYTPVLEHLVVMQIDSFPQYSPKMQLVCCRAIVKVFLALAAKGPVLRNCISTVVHQGLIRICSKPVVLPKGPESESEDHRASGEVRTGKWKVPTYKDYVDLFRHLLSSDQMMDSILADEAFFSVNSSSESLNHLLYDEFVKSVLKIVEKLDLTLEIQTVGEQENGDEAPGVWMIPTSDPAANLHPAKPKDFSAFINLVEFCREILPEKQAEFFEPWVYSFSYELILQSTRLPLISGFYKLLSITVRNAKKIKYFEGVSPKSLKHSPEDPEKYSCFALFVKFGKEVAVKMKQYKDELLASCLTFLLSLPHNIIELDVRAYVPALQMAFKLGLSYTPLAEVGLNALEEWSIYIDRHVMQPYYKDILPCLDGYLKTSALSDETKNNWEVSALSRAAQKGFNKVVLKHLKKTKNLSSNEAISLEEIRIRVVQMLGSLGGQINKNLLTVTSSDEMMKSYVAWDREKRLSFAVPFREMKPVIFLDVFLPRVTELALTASDRQTKVAACELLHSMVMFMLGKATQMPEGGQGAPPMYQLYKRTFPVLLRLACDVDQVTRQLYEPLVMQLIHWFTNNKKFESQDTVALLEAILDGIVDPVDSTLRDFCGRCIREFLKWSIKQITPQQQEKSPVNTKSLFKRLYSLALHPNAFKRLGASLAFNNIYREFREEESLVEQFVFEALVIYMESLALAHADEKSLGTIQQCCDAIDHLCRIIEKKHVSLNKAKKRRLPRGFPPSASLCLLDLVKWLLAHCGRPQTECRHKSIELFYKFVPLLPGNRSPNLWLKDVLKEEGVSFLINTFEGGGCGQPSGILAQPTLLYLRGPFSLQATLCWLDLLLAALECYNTFIGERTVGALQVLGTEAQSSLLKAVAFFLESIAMHDIIAAEKCFGTGAAGNRTSPQEGERYNYSKCTVVVRIMEFTTTLLNTSPEGWKLLKKDLCNTHLMRVLVQTLCEPASIGFNIGDVQVMAHLPDVCVNLMKALKMSPYKDILETHLREKITAQSIEELCAVNLYGPDAQVDRSRLAAVVSACKQLHRAGLLHNILPSQSTDLHHSVGTELLSLVYKGIAPGDERQCLPSLDLSCKQLASGLLELAFAFGGLCERLVSLLLNPAVLSTASLGSSQGSVIHFSHGEYFYSLFSETINTELLKNLDLAVLELMQSSVDNTKMVSAVLNGMLDQSFRERANQKHQGLKLATTILQHWKKCDSWWAKDSPLETKMAVLALLAKILQIDSSVSFNTSHGSFPEVFTTYISLLADTKLDLHLKGQAVTLLPFFTSLTGGSLEELRRVLEQLIVAHFPMQSREFPPGTPRFNNYVDCMKKFLDALELSQSPMLLELMTEVLCREQQHVMEELFQSSFRRIARRGSCVTQVGLLESVYEMFRKDDPRLSFTRQSFVDRSLLTLLWHCSLDALREFFSTIVVDAIDVLKSRFTKLNESTFDTQITKKMGYYKILDVMYSRLPKDDVHAKESKINQVFHGSCITEGNELTKTLIKLCYDAFTENMAGENQLLERRRLYHCAAYNCAISVICCVFNELKFYQGFLFSEKPEKNLLIFENLIDLKRRYNFPVEVEVPMERKKKYIEIRKEAREAANGDSDGPSYMSSLSYLADSTLSEEMSQFDFSTGVQSYSYSSQDPRPATGRFRRREQRDPTVHDDVLELEMDELNRHECMAPLTALVKHMHRSLGPPQGEEDSVPRDLPSWMKFLHGKLGNPIVPLNIRLFLAKLVINTEEVFRPYAKHWLSPLLQLAASENNGGEGIHYMVVEIVATILSWTGLATPTGVPKDEVLANRLLNFLMKHVFHPKRAVFRHNLEIIKTLVECWKDCLSIPYRLIFEKFSGKDPNSKDNSVGIQLLGIVMANDLPPYDPQCGIQSSEYFQALVNNMSFVRYKEVYAAAAEVLGLILRYVMERKNILEESLCELVAKQLKQHQNTMEDKFIVCLNKVTKSFPPLADRFMNAVFFLLPKFHGVLKTLCLEVVLCRVEGMTELYFQLKSKDFVQVMRHRDDERQKVCLDIIYKMMPKLKPVELRELLNPVVEFVSHPSTTCREQMYNILMWIHDNYRDPESETDNDSQEIFKLAKDVLIQGLIDENPGLQLIIRNFWSHETRLPSNTLDRLLALNSLYSPKIEVHFLSLATNFLLEMTSMSPDYPNPMFEHPLSECEFQEYTIDSDWRFRSTVLTPMFVETQASQGTLQTRTQEGSLSARWPVAGQIRATQQQHDFTLTQTADGRSSFDWLTGSSTDPLVDHTSPSSDSLLFAHKRSERLQRAPLKSVGPDFGKKRLGLPGDEVDNKVKGAAGRTDLLRLRRRFMRDQEKLSLMYARKGVAEQKREKEIKSELKMKQDAQVVLYRSYRHGDLPDIQIKHSSLITPLQAVAQRDPIIAKQLFSSLFSGILKEMDKFKTLSEKNNITQKLLQDFNRFLNTTFSFFPPFVSCIQDISCQHAALLSLDPAAVSAGCLASLQQPVGIRLLEEALLRLLPAELPAKRVRGKARLPPDVLRWVELAKLYRSIGEYDVLRGIFTSEIGTKQITQSALLAEARSDYSEAAKQYDEALNKQDWVDGEPTEAEKDFWELASLDCYNHLAEWKSLEYCSTASIDSENPPDLNKIWSEPFYQETYLPYMIRSKLKLLLQGEADQSLLTFIDKAMHGELQKAILELHYSQELSLLYLLQDDVDRAKYYIQNGIQSFMQNYSSIDVLLHQSRLTKLQSVQALTEIQEFISFISKQGNLSSQVPLKRLLNTWTNRYPDAKMDPMNIWDDIITNRCFFLSKIEEKLTPLPEDNSMNVDQDGDPSDRMEVQEQEEDISSLIRSCKFSMKMKMIDSARKQNNFSLAMKLLKELHKESKTRDDWLVSWVQSYCRLSHCRSRSQGCSEQVLTVLKTVSLLDENNVSSYLSKNILAFRDQNILLGTTYRIIANALSSEPACLAEIEEDKARRILELSGSSSEDSEKVIAGLYQRAFQHLSEAVQAAEEEAQPPSWSCGPAAGVIDAYMTLADFCDQQLRKEEENASVIDSAELQAYPALVVEKMLKALKLNSNEARLKFPRLLQIIERYPEETLSLMTKEISSVPCWQFISWISHMVALLDKDQAVAVQHSVEEITDNYPQAIVYPFIISSESYSFKDTSTGHKNKEFVARIKSKLDQGGVIQDFINALDQLSNPELLFKDWSNDVRAELAKTPVNKKNIEKMYERMYAALGDPKAPGLGAFRRKFIQTFGKEFDKHFGKGGSKLLRMKLSDFNDITNMLLLKMNKDSKPPGNLKECSPWMSDFKVEFLRNELEIPGQYDGRGKPLPEYHVRIAGFDERVTVMASLRRPKRIIIRGHDEREHPFLVKGGEDLRQDQRVEQLFQVMNGILAQDSACSQRALQLRTYSVVPMTSSDPRAPPCEYKDWLTKMSGKHDVGAYMLMYKGANRTETVTSFRKRESKVPADLLKRAFVRMSTSPEAFLALRSHFASSHALICISHWILGIGDRHLNNFMVAMETGGVIGIDFGHAFGSATQFLPVPELMPFRLTRQFINLMLPMKETGLMYSIMVHALRAFRSDPGLLTNTMDVFVKEPSFDWKNFEQKMLKKGGSWIQEINVAEKNWYPRQKICYAKRKLAGANPAVITCDELLLGHEKAPAFRDYVAVARGSKDHNIRAQEPESGLSEETQVKCLMDQATDPNILGRTWEGWEPWM

SEQ ID NO: 283 - protein, 1972 aa, Homo sapiens
MDPTGSQLDSDFSQQDTPCLIIEDSQPESQVLEDDSGSHFSMLSRHLPNLQTHKENPVLDVVSNPEQTAGEERGDGNSGFNEHLKENKVADPVDSSNLDTCGSISQVIEQLPQPNRTSSVLGMSVESAPAVEEEKGEELEQKEKEKEEDTSGNTTHSLGAEDTASSQLGFGVLELSQSQDVEENTVPYEVDKEQLQSVTTNSGYTRLSDVDANTAIKHEEQSNEDIPIAEQSSKDIPVTAQPSKDVHVVKEQNPPPARSEDMPFSPKASVAAMEAKEQLSAQELMESGLQIQKSPEPEVLSTQEDLFDQSNKTVSSDGCSTPSREEGGCSLASTPATTLHLLQLSGQRSLVQDSLSTNSSDLVAPSPDAFRSTPFIVPSSPTEQEGRQDKPMDTSVLSEEGGEPFQKKLQSGEPVELENPPLLPESTVSPQASTPISQSTPVFPPGSLPIPSQPQFSHDIFIPSPSLEEQSNDGKKDGDMHSSSLTVECSKTSEIEPKNSPEDLGLSLTGDSCKLMLSTSEYSQSPKMESLSSHRIDEDGENTQIEDTEPMSPVLNSKFVPAENDSILMNPAQDGEVQLSQNDDKTKGDDTDTRDDISILATGCKGREETVAEDVCIDLTCDSGSQAVPSPATRSEALSSVLDQEEAMEIKEHHPEEGSSGSEVEEIPETPCESQGEELKEENMESVPLHLSLTETQSQGLCLQKEMPKKECSEAMEVETSVISIDSPQKLAILDQELEHKEQEAWEEATSEDSSVVIVDVKEPSPRVDVSCEPLEGVEKCSDSQSWEDIAPEIEPCAENRLDTKEEKSVEYEGDLKSGTAETEPVEQDSSQPSLPLVRADDPLRLDQELQQPQTQEKTSNSLTEDSKMANAKQLSSDAEAQKLGKPSAHASQSFCESSSETPFHFTLPKEGDIIPPLTGATPPLIGHLKLEPKRHSTPIGISNYPESTIATSDVMSESMVETHDPILGSGKGDSGAAPDVDDKLCLRMKLVSPETEASEESLQFNLEKPATGERKNGSTAVAESVASPQKTMSVLSCICEARQENEARSEDPPTTPIRGNLLHFPSSQGEEEKEKLEGDHTIRQSQQPMKPISPVKDPVSPASQKMVIQGPSSPQGEAMVTDVLEDQKEGRSTNKENPSKALIERPSQNNIGIQTMECSLRVPETVSAATQTIKNVCEQGTSTVDQNFGKQDATVQTERGSGEKPVSAPGDDTESLHSQGEEEFDMPQPPHGHVLHRHMRTIREVRTLVTRVITDVYYVDGTEVERKVTEETEEPIVECQECETEVSPSQTGGSSGDLGDISSFSSKASSLHRTSSGTSLSAMHSSGSSGKGAGPLRGKTSGTEPADFALPSSRGGPGKLSPRKGVSQTGTPVCEEDGDAGLGIRQGGKAPVTPRGRGRRGRPPSRTTGTRETAVPGPLGIEDISPNLSPDDKSFSRVVPRVPDSTRRTDVGAGALRRSDSPEIPFQAAAGPSDGLDASSPGNSFVGLRVVAKWSSNGYFYSGKITRDVGAGKYKLLFDDGYECDVLGKDILLCDPIPLDTEVTALSEDEYFSAGVVKGHRKESGELYYSIEKEGQRKWYKRMAVILSLEQGNRLREQYGLGPYEAVTPLTKAADISLDNLVEGKRKRRSNVSSPATPTASSSSSTTPTRKITESPRASMGVLSGKRKLITSEEERSPAKRGRKSATVKPGAVGAGEFVSPCESGDNTGEPSALEEQRGPLPLNKTLFLGYAFLLTMATTSDKLASRSKLPDGPTGSSEEEEEFLEIPPFNKQYTESQLRAGAGYILEDFNEAQCNTAYQCLLIADQHCRTRKYFLCLASGIPCVSHVWVHDSCHANQLQNYRNYLLPAGYSLEEQRILDWQPRENPFQNLKVLLVSDQQQNFLELWSEILMTGGAASVKQHHSSAHNKDIALGVFDVVVTDPSCPASVLKCAEALQLPVVSQEWVIQCLIVGERIGFKQHPKYKHDYVSH

SEQ ID NO: 284 - protein, 1977 aa, Homo sapiens
MPGEQMDPTGSQLDSDFSQQDTPCLIIEDSQPESQVLEDDSGSHFSMLSRHLPNLQTHKENPVLDVVSNPEQTAGEERGDGNSGFNEHLKENKVADPVDSSNLDTCGSISQVIEQLPQPNRTSSVLGMSVESAPAVEEEKGEELEQKEKEKEEDTSGNTTHSLGAEDTASSQLGFGVLELSQSQDVEENTVPYEVDKEQLQSVTTNSGYTRLSDVDANTAIKHEEQSNEDIPIAEQSSKDIPVTAQPSKDVHVVKEQNPPPARSEDMPFSPKASVAAMEAKEQLSAQELMESGLQIQKSPEPEVLSTQEDLFDQSNKTVSSDGCSTPSREEGGCSLASTPATTLHLLQLSGQRSLVQDSLSTNSSDLVAPSPDAFRSTPFIVPSSPTEQEGRQDKPMDTSVLSEEGGEPFQKKLQSGEPVELENPPLLPESTVSPQASTPISQSTPVFPPGSLPIPSQPQFSHDIFIPSPSLEEQSNDGKKDGDMHSSSLTVECSKTSEIEPKNSPEDLGLSLTGDSCKLMLSTSEYSQSPKMESLSSHRIDEDGENTQIEDTEPMSPVLNSKFVPAENDSILMNPAQDGEVQLSQNDDKTKGDDTDTRDDISILATGCKGREETVAEDVCIDLTCDSGSQAVPSPATRSEALSSVLDQEEAMEIKEHHPEEGSSGSEVEEIPETPCESQGEELKEENMESVPLHLSLTETQSQGLCLQKEMPKKECSEAMEVETSVISIDSPQKLAILDQELEHKEQEAWEEATSEDSSVVIVDVKEPSPRVDVSCEPLEGVEKCSDSQSWEDIAPEIEPCAENRLDTKEEKSVEYEGDLKSGTAETEPVEQDSSQPSLPLVRADDPLRLDQELQQPQTQEKTSNSLTEDSKMANAKQLSSDAEAQKLGKPSAHASQSFCESSSETPFHFTLPKEGDIIPPLTGATPPLIGHLKLEPKRHSTPIGISNYPESTIATSDVMSESMVETHDPILGSGKGDSGAAPDVDDKLCLRMKLVSPETEASEESLQFNLEKPATGERKNGSTAVAESVASPQKTMSVLSCICEARQENEARSEDPPTTPIRGNLLHFPSSQGEEEKEKLEGDHTIRQSQQPMKPISPVKDPVSPASQKMVIQGPSSPQGEAMVTDVLEDQKEGRSTNKENPSKALIERPSQNNIGIQTMECSLRVPETVSAATQTIKNVCEQGTSTVDQNFGKQDATVQTERGSGEKPVSAPGDDTESLHSQGEEEFDMPQPPHGHVLHRHMRTIREVRTLVTRVITDVYYVDGTEVERKVTEETEEPIVECQECETEVSPSQTGGSSGDLGDISSFSSKASSLHRTSSGTSLSAMHSSGSSGKGAGPLRGKTSGTEPADFALPSSRGGPGKLSPRKGVSQTGTPVCEEDGDAGLGIRQGGKAPVTPRGRGRRGRPPSRTTGTRETAVPGPLGIEDISPNLSPDDKSFSRVVPRVPDSTRRTDVGAGALRRSDSPEIPFQAAAGPSDGLDASSPGNSFVGLRVVAKWSSNGYFYSGKITRDVGAGKYKLLFDDGYECDVLGKDILLCDPIPLDTEVTALSEDEYFSAGVVKGHRKESGELYYSIEKEGQRKWYKRMAVILSLEQGNRLREQYGLGPYEAVTPLTKAADISLDNLVEGKRKRRSNVSSPATPTASSSSSTTPTRKITESPRASMGVLSGKRKLITSEEERSPAKRGRKSATVKPGAVGAGEFVSPCESGDNTGEPSALEEQRGPLPLNKTLFLGYAFLLTMATTSDKLASRSKLPDGPTGSSEEEEEFLEIPPFNKQYTESQLRAGAGYILEDFNEAQCNTAYQCLLIADQHCRTRKYFLCLASGIPCVSHVWVHDSCHANQLQNYRNYLLPAGYSLEEQRILDWQPRENPFQNLKVLLVSDQQQNFLELWSEILMTGGAASVKQHHSSAHNKDIALGVFDVVVTDPSCPASVLKCAEALQLPVVSQEWVIQCLIVGERIGFKQHPKYKHDYVSH

SEQ ID NO: 285 - protein, 1975 aa, Homo sapiens
MPGEQMDPTGSQLDSDFSQQDTPCLIIEDSQPESQVLEDDSGSHFSMLSRHLPNLQTHKENPVLDVVSNPEQTAGEERGDGNSGFNEHLKENKVADPVDSSNLDTCGSISQVIEQLPQPNRTSSVLGMSVESAPAVEEEKGEELEQKEKEKEEDTSGNTTHSLGAEDTASSQLGFGVLELSQSQDVEENTVPYEVDKEQLQSVTTNSGYTRLSDVDANTAIKHEEQSNEDIPIAEQSSKDIPVTAQPSKDVHVVKEQNPPPARSEDMPFSPKASVAAMEAKEQLSAQELMESGLQIQKSPEPEVLSTQEDLFDQSNKTVSSDGCSTPSREEGGCSLASTPATTLHLLQLSGQRSLVQDSLSTNSSDLVAPSPDAFRSTPFIVPSSPTEQEGRQDKPMDTSVLSEEGGEPFQKKLQSGEPVELENPPLLPESTVSPQASTPISQSTPVFPPGSLPIPSQPQFSHDIFIPSPSLEEQSNDGKKDGDMHSSSLTVECSKTSEIEPKNSPEDLGLSLTGDSCKLMLSTSEYSQSPKMESLSSHRIDEDGENTQIEDTEPMSPVLNSKFVPAENDSILMNPAQDGEVQLSQNDDKTKGDDTDTRDDISILATGCKGREETVAEDVCIDLTCDSGSQAVPSPATRSEALSSVLDQEEAMEIKEHHPEEGSSGSEVEEIPETPCESQGEELKEENMESVPLHLSLTETQSQGLCLQKEMPKKECSEAMEVETSVISIDSPQKLAILDQELEHKEQEAWEEATSEDSSVVIVDVKEPSPRVDVSCEPLEGVEKCSDSQSWEDIAPEIEPCAENRLDTKEEKSVEYEGDLKSGTAETEPVEQDSSQPSLPLVRADDPLRLDQELQQPQTQEKTSNSLTEDSKMANAKQLSSDAEAQKLGKPSAHASQSFCESSSETPFHFTLPKEGDIIPPLTGATPPLIGHLKLEPKRHSTPIGISNYPESTIATSDVMSESMVETHDPILGSGKGDSGAAPDVDDKLCLRMKLVSPETEASEESLQFNLEKPATGERKNGSTAVAESVASPQKTMSVLSCICEARQENEARSEDPPTTPIRGNLLHFPSSQGEEEKEKLEGDHTIRQSQQPMKPISPVKDPVSPASQKMVIQGPSSPQGEAMVTDVLEDQKEGRSTNKENPSKALIERPSQNNIGIQTMECSLRVPETVSAATQTIKNVCEQGTSTVDQNFGKQDATVQTERGSGEKPVSAPGDDTESLHSQGEEEFDMPQPPHGHVLHRHMRTIREVRTLVTRVITDVYYVDGTEVERKVTEETEEPIVECQECETEVSPSQTGGSSGDLGDISSFSSKASSLHRTSSGTSLSAMHSSGSSGKGAGPLRGKTSGTEPADFALPSSRGGPGKLSPRKGVSQTGTPVCEEDGDAGLGIRQGGKAPVTPRGRGRRGRPPSRTTGTRETAVPGPLGIEDISPNLSPDDKSFSRVVPRVPDSTRRTDVGAGALRRSDSPEIPFQAAAGPSDGLDASSPGNSFVGLRVVAKWSSNGYFYSGKITRDVGAGKYKLLFDDGYECDVLGKDILLCDPIPLDTEVTALSEDEYFSAGVVKGHRKESGELYYSIEKEGQRKWYKRMAVILSLEQGNRLREQYGLGPYEAVTPLTKAADISLDNLVEGKRKRRSNVSSPATPTASSSSSTTPTRKITESPRASMGVLSGKRKLITSEEERSPAKRGRKSATVKPVGAGEFVSPCESGDNTGEPSALEEQRGPLPLNKTLFLGYAFLLTMATTSDKLASRSKLPDGPTGSSEEEEEFLEIPPFNKQYTESQLRAGAGYILEDFNEAQCNTAYQCLLIADQHCRTRKYFLCLASGIPCVSHVWVHDSCHANQLQNYRNYLLPAGYSLEEQRILDWQPRENPFQNLKVLLVSDQQQNFLELWSEILMTGGAASVKQHHSSAHNKDIALGVFDVVVTDPSCPASVLKCAEALQLPVVSQEWVIQCLIVGERIGFKQHPKYKHDYVSH

SEQ ID NO: 286 - protein, 336 aa, Homo sapiens
MERKISRIHLVSEPSITHFLQVSWEKTLESGFVITLTDGHSAWTGTVSESEISQEADDMAMEKGKYVGELRKALLSGAGPADVYTFNFSKESCYFFFEKNLKDVSFRLGSFNLEKVENPAEVIRELICYCLDTIAENQAKNEHLQKENERLLRDWNDVQGRFEKCVSAKEALETDLYKRFILVLNEKKTKIRSLHNKLLNAAQEREKDIKQEGETAICSEMTADRDPVYDESTDEESENQTDLSGLASAAVSKDDSIISSLDVTDIAPSRKRRQRMQRNLGTEPKMAPQENQLQEKENSRPDSSLPETSKKEHISAENMSLETLRNSSPEDLFDEI

SEQ ID NO: 287 - protein, 334 aa, Homo sapiens
MERKISRIHLVSEPSITHFLQVSWEKTLESGFVITLTDGHSAWTGTVSESEISQEADDMAMEKGKYVGELRKALLSGAGPADVYTFNFSKESCYFFFEKNLKDVSFRLGSFNLEKVENPAEVIRELICYCLDTIAENQAKNEHLQKENERLLRDWNDVQGRFEKCVSAKEALETDLYKRFILVLNEKKTKIRSLHNKLLNAAQEREKDIKQEGETAICSEMTADRDPVYDESTDEESENQTDLSGLASAAVSKDDSIISSLDVTDIAPSRKRRQRMQRNLGTEPKMAPQENQLQEKEKPDSSLPETSKKEHISAENMSLETLRNSSPEDLFDEI

SEQ ID NO: 288 - protein, 310 aa, Homo sapiens
MERKISRIHLVSEPSITHFLQVSWEKTLESGFVITLTDGHSAWTGTVSESEISQEADDMAMEKGKYVGELRKALLSGAGPADVYTFNFSKESCYFFFEKNLKDVSFRLGSFNLEKVENPAEVIRELICYCLDTIAENQAKNEHLQKENERLLRDWNDVQGRFEKCVSAKEALETDLYKRFILVLNEKKTKIRSLHNKLLNAAQEREKDIKQEGETAICSEMTADRDPVYDESTDEESENQTDLSGLASAAVSKDDSIISSLDVTDIAPSRKRRQRMQRNLGTEPKMAPQENQLQEKEKGRKKETSEKEAV

SEQ ID NO: 289 - protein, 911 aa, Homo sapiens
MAASQTSQTVASHVPFADLCSTLERIQKSKGRAEKIRHFREFLDSWRKFHDALHKNHKDVTDSFYPAMRLILPQLERERMAYGIKETMLAKLYIELLNLPRDGKDALKLLNYRTPTGTHGDAGDFAMIAYFVLKPRCLQKGSLTIQQVNDLLDSIASNNSAKRKDLIKKSLLQLITQSSALEQKWLIRMIIKDLKLGVSQQTIFSVFHNDAAELHNVTTDLEKVCRQLHDPSVGLSDISITLFSAFKPMLAAIADIEHIEKDMKHQSFYIETKLDGERMQMHKDGDVYKYFSRNGYNYTDQFGASPTEGSLTPFIHNAFKADIQICILDGEMMAYNPNTQTFMQKGTKFDIKRMVEDSDLQTCYCVFDVLMVNNKKLGHETLRKRYEILSSIFTPIPGRIEIVQKTQAHTKNEVIDALNEAIDKREEGIMVKQPLSIYKPDKRGEGWLKIKPEYVSGLMDELDILIVGGYWGKGSRGGMMSHFLCAVAEKPPPGEKPSVFHTLSRVGSGCTMKELYDLGLKLAKYWKPFHRKAPPSSILCGTEKPEVYIEPCNSVIVQIKAAEIVPSDMYKTGCTLRFPRIEKIRDDKEWHECMTLDDLEQLRGKASGKLASKHLYIGGDDEPQEKKRKAAPKMKKVIGIIEHLKAPNLTNVNKISNIFEDVEFCVMSGTDSQPKPDLENRIAEFGGYIVQNPGPDTYCVIAGSENIRVKNIILSNKHDVVKPAWLLECFKTKSFVPWQPRFMIHMCPSTKEHFAREYDCYGDSYFIDTDLNQLKEVFSGIKNSNEQTPEEMASLIADLEYRYSWDCSPLSMFRRHTVYLDSYAVINDLSTKNEGTRLAIKALELRFHGAKVVSCLAEGVSHVIIGEDHSRVADFKAFRRTFKRKFKILKESWVTDSIDKCELQEENQYLI

SEQ ID NO: 290 - protein, 299 aa, Homo sapiens
MEELEQGLLMQPWAWLQLAENSLLAKVFITKQGYALLVSDLQQVWHEQVDTSVVSQRAKELNKRLTAPPAAFLCHLDNLLRPLLKDAAHPSEATFSCDCVADALILRVRSELSGLPFYWNFHCMLASPSLVSQHLIRPLMGMSLALQCQVRELATLLHMKDLEIQDYQESGATLIRDRLKTEPFEENSFLEQFMIEKLPEACSIGDGKPFVMNLQDLYMAVTTQEVQVGQKHQGAGDPHTSNSASLQGIDSQCVNQPEQLVSSAPTLSAPEKESTGTSGPLQRPQLSKVKRKKPRGLFS

SEQ ID NO: 291 - protein, 316 aa, Homo sapiens
MEELEQGLLMQPWAWLQLAENSLLAKVFITKQGYALLVSDLQQVWHEQVDTSVVSQRAKELNKRLTAPPAAFLCHLDNLLRPLLKDAAHPSEATFSCDCVADALILRVRSELSGLPFYWNFHCMLASPSLVSQHLIRPLMGMSLALQCQVRELATLLHMKDLEIQDYQESGATLIRDRLKTEPFEENSFLEQFMIEKLPEACSIGDGKPFVMNLQDLYMAVTTQEVQVGQKHQGAGDPHTSNSASLQGIDSQCVNQPEQLVSSAPTLSAPEKESTALCRDLSCQRSRGRSQGVSSVNLLWPQLLRMDLENSFQASP

SEQ ID NO: 292 - protein, 692 aa, Homo sapiens
MSSFEGQMAEYPTISIDRFDRENLRARAYFLSHCHKDHMKGLRAPTLKRRLECSLKVYLYCSPVTKELLLTSPKYRFWKKRIISIEIETPTQISLVDEASGEKEEIVVTLLPAGHCPGSVMFLFQGNNGTVLYTGDFRLAQGEAARMELLHSGGRVKDIQSVYLDTTFCDPRFYQIPSREECLSGVLELVRSWITRSPYHVVWLNCKAAYGYEYLFTNLSEELGVQVHVNKLDMFRNMPEILHHLTTDRNTQIHACRHPKAEEYFQWSKLPCGITSRNRIPLHIISIKPSTMWFGERSRKTNVIVRTGESSYRACFSFHSSYSEIKDFLSYLCPVNAYPNVIPVGTTMDKVVEILKPLCRSSQSTEPKYKPLGKLKRARTVHRDSEEEDDYLFDDPLPIPLRHKVPYPETFHPEVFSMTAVSEKQPEKLRQTPGCCRAECMQSSRFTNFVDCEESNSESEEEVGIPASLQGDLGSVLHLQKADGDVPQWEVFFKRNDEITDESLENFPSSTVAGGSQSPKLFSDSDGESTHISSQNSSQSTHITEQGSQGWDSQSDTVLLSSQERNSGDITSLDKADYRPTIKENIPASLMEQNVICPKDTYSDLKSRDKDVTIVPSTGEPTTLSSETHIPEEKSLLNLSTNADSQSSSDFEVPSTPEAELPKREHLQYLYEKLATGESIAVKKRKCSLLDT

SEQ ID NO: 293 - protein, 577 aa, Homo sapiens
MKHQERFLFQGNNGTVLYTGDFRLAQGEAARMELLHSGGRVKDIQSVYLDTTFCDPRFYQIPSREECLSGVLELVRSWITRSPYHVVWLNCKAAYGYEYLFTNLSEELGVQVHVNKLDMFRNMPEILHHLTTDRNTQIHACRHPKAEEYFQWSKLPCGITSRNRIPLHIISIKPSTMWFGERSRKTNVIVRTGESSYRACFSFHSSYSEIKDFLSYLCPVNAYPNVIPVGTTMDKVVEILKPLCRSSQSTEPKYKPLGKLKRARTVHRDSEEEDDYLFDDPLPIPLRHKVPYPETFHPEVFSMTAVSEKQPEKLRQTPGCCRAECMQSSRFTNFVDCEESNSESEEEVGIPASLQGDLGSVLHLQKADGDVPQWEVFFKRNDEITDESLENFPSSTVAGGSQSPKLFSDSDGESTHISSQNSSQSTHITEQGSQGWDSQSDTVLLSSQERNSGDITSLDKADYRPTIKENIPASLMEQNVICPKDTYSDLKSRDKDVTIVPSTGEPTTLSSETHIPEEKSLLNLSTNADSQSSSDFEVPSTPEAELPKREHLQYLYEKLATGESIAVKKRKCSLLDT

SEQ ID NO: 294 - protein, 572 aa, Homo sapiens
MFLFQGNNGTVLYTGDFRLAQGEAARMELLHSGGRVKDIQSVYLDTTFCDPRFYQIPSREECLSGVLELVRSWITRSPYHVVWLNCKAAYGYEYLFTNLSEELGVQVHVNKLDMFRNMPEILHHLTTDRNTQIHACRHPKAEEYFQWSKLPCGITSRNRIPLHIISIKPSTMWFGERSRKTNVIVRTGESSYRACFSFHSSYSEIKDFLSYLCPVNAYPNVIPVGTTMDKVVEILKPLCRSSQSTEPKYKPLGKLKRARTVHRDSEEEDDYLFDDPLPIPLRHKVPYPETFHPEVFSMTAVSEKQPEKLRQTPGCCRAECMQSSRFTNFVDCEESNSESEEEVGIPASLQGDLGSVLHLQKADGDVPQWEVFFKRNDEITDESLENFPSSTVAGGSQSPKLFSDSDGESTHISSQNSSQSTHITEQGSQGWDSQSDTVLLSSQERNSGDITSLDKADYRPTIKENIPASLMEQNVICPKDTYSDLKSRDKDVTIVPSTGEPTTLSSETHIPEEKSLLNLSTNADSQSSSDFEVPSTPEAELPKREHLQYLYEKLATGESIAVKKRKCSLLDT

SEQ ID NO: 295 - protein, 511 aa, Homo sapiens
MSGGFELQPRDGGPRVALAPGETVIGRGPLLGITDKRVSRRHAILEVAGGQLRIKPIHTNPCFYQSSEKSQLLPLKPNLWCYLNPGDSFSLLVDKYIFRILSIPSEVEMQCTLRNSQVLDEDNILNETPKSPVINLPHETTGASQLEGSTEIAKTQMTPTNSVSFLGENRDCNKQQPILAERKRILPTWMLAEHLSDQNLSVPAISGGNVIQGSGKEEICKDKSQLNTTQQGRRQLISSGSSENTSAEQDTGEECKNTDQEESTISSKEMPQSFSAITLSNTEMNNIKTNAQRNKLPIEELGKVSKHKIATKRTPHKEDEAMSCSENCSSAQGDSLQDESQGSHSESSSNPSNPETLHAKATDSVLQGSEGNKVKRTSCMYGANCYRKNPVHFQHFSHPGDSDYGGVQIVGQDETDDRPECPYGPSCYRKNPQHKIEYRHNTLPVRNVLDEDNDNVGQPNEYDLNDSFLDDEEEDYEPTDEDSDWEPGKEDEEKEDVEELLKEAKRFMKRK

SEQ ID NO: 296 - protein, 521 aa, Homo sapiens
MGEVEAPGRLWLESPPGGAPPIFLPSDGQALVLGRGPLTQVTDRKCSRTQVELVADPETRTVAVKQLGVNPSTTGTQELKPGLEGSLGVGDTLYLVNGLHPLTLRWEETRTPESQPDTPPGTPLVSQDEKRDAELPKKRMRKSNPGWENLEKLLVFTAAGVKPQGKVAGFDLDGTLITTRSGKVFPTGPSDWRILYPEIPRKLRELEAEGYKLVIFTNQMSIGRGKLPAEEFKAKVEAVVEKLGVPFQVLVATHAGLYRKPVTGMWDHLQEQANDGTPISIGDSIFVGDAAGRPANWAPGRKKKDFSCADRLFALNLGLPFATPEEFFLKWPAAGFELPAFDPRTVSRSGPLCLPESRALLSASPEVVVAVGFPGAGKSTFLKKHLVSAGYVHVNRDTLGSWQRCVTTCETALKQGKRVAIDNTNPDAASRARYVQCARAAGVPCRCFLFTATLEQARHNNRFREMTDSSHIPVSDMVMYGYRKQFEAPTLAEGFSAILEIPFRLWVEPRLGRLYCQFSEG

SEQ ID NO: 297 - protein, 482 aa, Homo sapiens
MQILTPPLQSSVELVADPETRTVAVKQLGVNPSTTGTQELKPGLEGSLGVGDTLYLVNGLHPLTLRWEETRTPESQPDTPPGTPLVSQDEKRDAELPKKRMRKSNPGWENLEKLLVFTAAGVKPQGKVAGFDLDGTLITTRSGKVFPTGPSDWRILYPEIPRKLRELEAEGYKLVIFTNQMSIGRGKLPAEEFKAKVEAVVEKLGVPFQVLVATHAGLYRKPVTGMWDHLQEQANDGTPISIGDSIFVGDAAGRPANWAPGRKKKDFSCADRLFALNLGLPFATPEEFFLKWPAAGFELPAFDPRTVSRSGPLCLPESRALLSASPEVVVAVGFPGAGKSTFLKKHLVSAGYVHVNRDTLGSWQRCVTTCETALKQGKRVAIDNTNPDAASRARYVQCARAAGVPCRCFLFTATLEQARHNNRFREMTDSSHIPVSDMVMYGYRKQFEAPTLAEGFSAILEIPFRLWVEPRLGRLYCQFSEG

SEQ ID NO: 298 - protein, 2472 aa, Homo sapiens
MTARGQSPLAPLLETLEDPSASHGGQTDAYLTLTSRMTGEEGKEVITEIEKKLPRLYKVLKTHISSQNSELSSAALQALGFCLYNPKITSELSEANALELLSKLNDTIKNSDKNVRTRALWVISKQTFPSEVVGKMVSSIIDSLEILFNKGETHSAVVDFEALNVIVRLIEQAPIQMGEEAVRWAKLVIPLVVHSAQKVHLRGATALEMGMPLLLQKQQEIASITEQLMTTKLISELQKLFMSKNETYVLKLWPLFVKLLGRTLHRSGSFINSLLQLEELGFRSGAPMIKKIAFIAWKSLIDNFALNPDILCSAKRLKLLMQPLSSIHVRTETLALTKLEVWWYLLMRLGPHLPANFEQVCVPLIQSTISIDSNASPQGNSCHVATSPGLNPMTPVHKGASSPYGAPGTPRMNLSSNLGGMATIPSIQLLGLEMLLHFLLGPEALSFAKQNKLVLSLEPLEHPLISSPSFFSKHANTLITAVHDSFVAVGKDAPDVVVSAIWKELISLVKSVTESGNKKEKPGSEVLTLLLKSLESIVKSEVFPVSKTLVLMEITIKGLPQKVLGSPAYQVANMDILNGTPALFLIQLIFNNFLECGVSDERFFLSLESLVGCVLSGPTSPLAFSDSVLNVINQNAKQLENKEHLWKMWSVIVTPLTELINQTNEVNQGDALEHNFSAIYGALTLPVNHIFSEQRFPVATMKTLLRTWSELYRAFARCAALVATAEENLCCEELSSKIMSSLEDEGFSNLLFVDRIIYIITVMVDCIDFSPYNIKYQPKVKSPQRPSDWSKKKNEPLGKLTSLFKLIVKVIYSFHTLSFKEAHSDTLFTIGNSITGIISSVLGHISLPSMIRKIFATLTRPLALFYENSKLDEVPKVYSCLNNKLEKLLGEIIACLQFSYTGTYDSELLEQLSPLLCIIFLHKNKQIRKQSAQFWNATFAKVMMLVYPEELKPVLTQAKQKFLLLLPGLETVEMMEESSGPYSDGTENSQLNVKISGMERKSNGKRDSFLAQTKNKKENMKPAAKLKLESSSLKVKGEILLEEEKSTDFVFIPPEGKDAKERILTDHQKEVLKTKRCDIPAMYNNLDVSQDTLFTQYSQEEPMEIPTLTRKPKEDSKMMITEEQMDSDIVIPQDVTEDCGMAEHLEKSSLSNNECGSLDKTSPEMSNSNNDERKKALISSRKTSTECASSTENSFVVSSSSVSNTTVAGTPPYPTSRRQTFITLEKFDGSENRPFSPSPLNNISSTVTVKNNQETMIKTDFLPKAKQREGTFSKSDSEKIVNGTKRSSRRAGKAEQTGNKRSKPLMRSEPEKNTEESVEGIVVLENNPPGLLNQTECVSDNQVHLSESTMEHDNTKLKAATVENAVLLETNTVEEKNVEINLESKENTPPVVISADQMVNEDSQVQITPNQKTLRRSSRRRSEVVESTTESQDKENSHQKKERRKEEEKPLQKSPLHIKDDVLPKQKLIAEQTLQENLIEKGSNLHEKTLGETSANAETEQNKKKADPENIKSEGDGTQDIVDKSSEKLVRGRTRYQTRRASQGLLSSIENSESDSSEAKEEGSRKKRSGKWKNKSNESVDIQDQEEKVVKQECIKAENQSHDYKATSEEDVSIKSPICEKQDESNTVICQDSTVTSDLLQVPDDLPNVCEEKNETSKYAEYSFTSLPVPESNLRTRNAIKRLHKRDSFDNCSLGESSKIGISDISSLSEKTFQTLECQHKRSRRVRRSKGCDCCGEKSQPQEKSLIGLKNTENNDVEISETKKADVQAPVSPSETSQANPYSEGQFLDEHHSVNFHLGLKEDNDTINDSLIVSETKSKENTMQESLPSGIVNFREEICDMDSSEAMSLESQESPNENFKTVGPCLGDSKNVSQESLETKEEKPEETPKMELSLENVTVEGNACKVTESNLEKAKTMELNVGNEASFHGQERTKTGISEEAAIEENKRNDDSEADTAKLNAKEVATEEFNSDISLSDNTTPVKLNAQTEISEQTAAGELDGGNDVSDLHSSEETNTKMKNNEEMMIGEAMAETGHDGETENEGITTKTSKPDEAETNMLTAEMDNFVCDTVEMSTEEGIIDANKTETNTEYSKSEEKLDNNQMVMESDILQEDHHTSQKVEEPSQCLASGTAISELIIEDNNASPQKLRELDPSLVSANDSPSGMQTRCVWSPLASPSTSILKRGLKRSQEDEISSPVNKVRRVSFADPIYQAGLADDIDRRCSIVRSHSSNSSPIGKSVKTSPTTQSKHNTTSAKGFLSPGSRSPKFKSSKKCLISEMAKESIPCPTESVYPPLVNCVAPVDIILPQITSNMWARGLGQLIRAKNIKTIGDLSTLTASEIKTLPIRSPKVSNVKKALRIYHEQQVKTRGLEEIPVFDISEKTVNGIENKSLSPDEERLVSDIIDPVALEIPLSKNLLAQISALALQLDSEDLHNYSGSQLFEMHEKLSCMANSVIKNLQSRWRSPSHENSI

SEQ ID NO: 299 - protein, 2446 aa, Homo sapiens
MTARGQSPLAPLLETLEDPSASHGGQTDAYLTLTSRMTGEEGKEVITEIEKKLPRLYKVLKTHISSQNSELSSAALQALGFCLYNPKITSELSEANALELLSKLNDTIKNSDKNVRTRALWVISKQTFPSEVVGKMVSSIIDSLEILFNKGETHSAVVDFEALNVIVRLIEQAPIQMGEEAVRWAKLVIPLVVHSAQKVHLRGATALEMGMPLLLQKQQEIASITEQLMTTKLISELQKLFMSKNETYVLKLWPLFVKLLGRTLHRSGSFINSLLQLEELGFRSGAPMIKKIAFIAWKSLIDNFALNPDILCSAKRLKLLMQPLSSIHVRTETLALTKLEVWWYLLMRLGPHLPANFEQVCVPLIQSTISIDSNASPQGNSCHVATSPGLNPMTPVHKGASSPYGAPGTPRMNLSSNLGGMATIPSIQLLGLEMLLHFLLGPEALSFAKQNKLVLSLEPLEHPLISSPSFFSKHANTLITAVHDSFVAVGKDAPDVVVSAIWKELISLVKSVTESGNKKEKPGSEVLTLLLKSLESIVKSEVFPVSKTLVLMEITIKGLPQKVLGSPAYQVANMDILNGTPALFLIQLIFNNFLECGVSDERFFLSLESLVGCVLSGPTSPLAFSDSVLNVINQNAKQLENKEHLWKMWSVIVTPLTELINQTNEVNQGDALEHNFSAIYGALTLPVNHIFSEQRFPVATMKTLLRTWSELYRAFARCAALVATAEENLCCEELSSKIMSSLEDEGFSNLLFVDRIIYIITVMVDCIDFSPYNIKYQPKVKSPQRPSDWSKKKNEPLGKLTSLFKLIVKVIYSFHTLSFKEAHSDTLFTIGNSITGIISSVLGHISLPSMIRKIFATLTRPLALFYENSKLDEVPKVYSCLNNKLEKLLGEIIACLQFSYTGTYDSELLEQLSPLLCIIFLHKNKQIRKQSAQFWNATFAKVMMLVYPEELKPVLTQAKQKFLLLLPGLETVEMMEESSGPYSDGTENSQLNVKISGMERKSNGKRDSFLAQTKNKKENMKPAAKLKLESSSLKVKGEILLEEEKSTDFVFIPPEGKDAKERILTDHQKEVLKTKRCDIPAMYNNLDVSQDTLFTQYSQEEPMEIPTLTRKPKEDSKMMITEEQMDSDIVIPQDVTEDCGMAEHLEKSSLSNNECGSLDKTSPEMSNSNNDERKKALISSRKTSTECASSTENSFVVSSSSVSNTTVAGTPPYPTSRRQTFITLEKFDGSENRPFSPSPLNNISSTVTVKNNQETMIKTDFLPKAKQREGTFSKSDSEKIVNGTKRSSRRAGKAEQTGNKRSKPLMRSEPEKNTEESVEGIVVLENNPPGLLNQTECVSDNQVHLSESTMEHDNTKLKAATVENAVLLETNTVEEKNVEINLESKENTPPVVISADQMVNEDSQVQITPNQKTLRRSSRRRSEVVESTTESQDKENSHQKKERRKEEEKPLQKSPLHIKDDVLPKQKLIAEQTLQENLIEKGSNLHEKTLGETSANAETEQNKKKADPENIKSEGDGTQDIVDKSSEKLVRGRTRYQTRRASQGLLSSIENSESDSSEAKEEGSRKKRSGKWKNKSNESVDIQDQEEKVVKQECIKAENQSHDYKATSEEDVSIKSPICEKQDESNTVICQDSTVTSDLLQVPDDLPNVCEEKNETSKYAEYSFTSLPVPESNLRTRNAIKRLHKRDSFDNCSLGESSKIGISDISSLSEKTFQTLECQHKRSRRVRRSKGCDCCGEKSQPQEKSLIGLKNTENNDVEISETKKADVQAPVSPSETSQANPYSEGQFLDEHHSVNFHLGLKEDNDTINDSLIVSETKSKENTMQESLPSGIVNFREEICDMDSSEAMSLESQESPNENFKTVGPCLGDSKNVSQESLETKEEKPEETPKMELSLENVTVEGNACKVTESNLEKAKTMELNVGNEASFHGQERTKTGISEEAAIEENKRNDDSEADTAKLNAKEVATEEFNSDISLSDNTTPVKLNAQTEISEQTAAGELDGGNDVSDLHSSEETNTKMKNNEEMMIGEAMAETGHDGETENEGITTKTSKPDEAETNMLTAEMDNFVCDTVEMSTEEGIIDANKTETNTEYSKSEEKLDNNQMVMESDILQEDHHTSQKVEEPSQCLASGTAISELIIEDNNASPQKLRELDPSLVSANDSPSGMQTRCVWSPLASPSTSILKRGLKRSQEDEISSPVNKVRRVSFADPIYQAGLADDIDRRCSIVRSHSSNSSPIGKSVKTSPTTQSKISEMAKESIPCPTESVYPPLVNCVAPVDIILPQITSNMWARGLGQLIRAKNIKTIGDLSTLTASEIKTLPIRSPKVSNVKKALRIYHEQQVKTRGLEEIPVFDISEKTVNGIENKSLSPDEERLVSDIIDPVALEIPLSKNLLAQISALALQLDSEDLHNYSGSQLFEMHEKLSCMANSVIKNLQSRWRSPSHENSI

SEQ ID NO: 300 - protein, 1069 aa, Homo sapiens
MSDQAPKVPEEMFREVKYYAVGDIDPQVIQLLKAGKAKEVSYNALASHIISEDGDNPEVGEAREVFDLPVVKPSWVILSVQCGTLLPVNGFSPESCQIFFGITACLSQVSSEDRSALWALVTFYGGDCQLTLNKKCTHLIVPEPKGEKYECALKRASIKIVTPDWVLDCVSEKTKKDEAFYHPRLIIYEEEEEEEEEEEEVENEEQDSQNEGSTDEKSSPASSQEGSPSGDQQFSPKSNTEKSKGELMFDDSSDSSPEKQERNLNWTPAEVPQLAAAKRRLPQGKEPGLINLCANVPPVPGNILPPEVRGNLMAAGQNLQSSERSEMIATWSPAVRTLRNITNNADIQQMNRPSNVAHILQTLSAPTKNLEQQVNHSQQGHTNANAVLFSQVKVTPETHMLQQQQQAQQQQQQHPVLHLQPQQIMQLQQQQQQQISQQPYPQQPPHPFSQQQQQQQQAHPHQFSQQQLQFPQQQLHPPQQLHRPQQQLQPFQQQHALQQQFHQLQQHQLQQQQLAQLQQQHSLLQQQQQQQIQQQQLQRMHQQQQQQQMQSQTAPHLSQTSQALQHQVPPQQPPQQQQQQQPPPSPQQHQLFGHDPAVEIPEEGFLLGCVFAIADYPEQMSDKQLLATWKRIIQAHGGTVDPTFTSRCTHLLCESQVSSAYAQAIRERKRCVTAHWLNTVLKKKKMVPPHRALHFPVAFPPGGKPCSQHIISVTGFVDSDRDDLKLMAYLAGAKYTGYLCRSNTVLICKEPTGLKYEKAKEWRIPCVNAQWLGDILLGNFEALRQIQYSRYTAFSLQDPFAPTQHLVLNLLDAWRVPLKVSAELLMSIRLPPKLKQNEVANVQPSSKRARIEDVPPPTKKLTPELTPFVLFTGFEPVQVQQYIKKLYILGGEVAESAQKCTHLIASKVTRTVKFLTAISVVKHIVTPEWLEECFRCQKFIDEQNYILRDAEAEVLFSFSLEESLKRAHVSPLFKAKYFYITPGICPSLSTMKAIVECAGGKVLSKQPSFRKLMEHKQNSSLSEIILISCENDLHLCREYFARGIDVHNAEFVLTGVLTQTLDYESYKFN

SEQ ID NO: 301 - protein, 822 aa, Homo sapiens
MFDDSSDSSPEKQERNLNWTPAEVPQLAAAKRRLPQGKEPGLINLCANVPPVPGNILPPEVRGNLMAAGQNLQSSERSEMIATWSPAVRTLRNITNNADIQQMNRPSNVAHILQTLSAPTKNLEQQVNHSQQGHTNANAVLFSQVKVTPETHMLQQQQQAQQQQQQHPVLHLQPQQIMQLQQQQQQQISQQPYPQQPPHPFSQQQQQQQQAHPHQFSQQQLQFPQQQLHPPQQLHRPQQQLQPFQQQHALQQQFHQLQQHQLQQQQLAQLQQQHSLLQQQQQQQIQQQQLQRMHQQQQQQQMQSQTAPHLSQTSQALQHQVPPQQPPQQQQQQQPPPSPQQHQLFGHDPAVEIPEEGFLLGCVFAIADYPEQMSDKQLLATWKRIIQAHGGTVDPTFTSRCTHLLCESQVSSAYAQAIRERKRCVTAHWLNTVLKKKKMVPPHRALHFPVAFPPGGKPCSQHIISVTGFVDSDRDDLKLMAYLAGAKYTGYLCRSNTVLICKEPTGLKYEKAKEWRIPCVNAQWLGDILLGNFEALRQIQYSRYTAFSLQDPFAPTQHLVLNLLDAWRVPLKVSAELLMSIRLPPKLKQNEVANVQPSSKRARIEDVPPPTKKLTPELTPFVLFTGFEPVQVQQYIKKLYILGGEVAESAQKCTHLIASKVTRTVKFLTAISVVKHIVTPEWLEECFRCQKFIDEQNYILRDAEAEVLFSFSLEESLKRAHVSPLFKAKYFYITPGICPSLSTMKAIVECAGGKVLSKQPSFRKLMEHKQNSSLSEIILISCENDLHLCREYFARGIDVHNAEFVLTGVLTQTLDYESYKFN

SEQ ID NO: 302 - protein, 1069 aa, Homo sapiens; identical to SEQ ID NO: 300

SEQ ID NO: 303 - DNA, 19 bp, Artificial Sequence
  Synthetic
cagatatcagcttagacaa

SEQ ID NO: 304 - protein, 949 aa, Homo sapiens
MSLAFKIFFPQTLRALSRKELCLFRKHHWRDVRQFSQWSETDLLHGHPLFLRRKPVLSFQGSHLRSRATYLVFLPGLHVGLCSGPCEMAEQRFCVDYAKRGTAGCKKCKEKIVKGVCRIGKVVPNPFSESGGDMKEWYHIKCMFEKLERARATTKKIEDLTELEGWEELEDNEKEQITQHIADLSSKAAGTPKKKAVVQAKLTTTGQVTSPVKGASFVTSTNPRKFSGFSAKPNNSGEAPSSPTPKRSLSSSKCDPRHKDCLLREFRKLCAMVADNPSYNTKTQIIQDFLRKGSAGDGFHGDVYLTVKLLLPGVIKTVYNLNDKQIVKLFSRIFNCNPDDMARDLEQGDVSETIRVFFEQSKSFPPAAKSLLTIQEVDEFLLRLSKLTKEDEQQQALQDIASRCTANDLKCIIRLIKHDLKMNSGAKHVLDALDPNAYEAFKASRNLQDVVERVLHNAQEVEKEPGQRRALSVQASLMTPVQPMLAEACKSVEYAMKKCPNGMFSEIKYDGERVQVHKNGDHFSYFSRSLKPVLPHKVAHFKDYIPQAFPGGHSMILDSEVLLIDNKTGKPLPFGTLGVHKKAAFQDANVCLFVFDCIYFNDVSLMDRPLCERRKFLHDNMVEIPNRIMFSEMKRVTKALDLADMITRVIQEGLEGLVLKDVKGTYEPGKRHWLKVKKDYLNEGAMADTADLVVLGAFYGQGSKGGMMSIFLMGCYDPGSQKWCTVTKCAGGHDDATLARLQNELDMVKISKDPSKIPSWLKVNKIYYPDFIVPDPKKAAVWEITGAEFSKSEAHTADGISIRFPRCTRIRDDKDWKSATNLPQLKELYQLSKEKADFTVVAGDEGSSTTGGSSEENKGPSGSAVSRKAPSKPSASTKKAEGKLSNSNSKDGNMQTAKPSAMKVGEKLATKSSPVKVGEKRKAADETLCQTKRRPASEQRGRTVPAGRR

SEQ ID NO: 305 - protein, 1009 aa, Homo sapiens
MSLAFKIFFPQTLRALSRKELCLFRKHHWRDVRQFSQWSETDLLHGHPLFLRRKPVLSFQGSHLRSRATYLVFLPGLHVGLCSGPCEMAEQRFCVDYAKRGTAGCKKCKEKIVKGVCRIGKVVPNPFSESGGDMKEWYHIKCMFEKLERARATTKKIEDLTELEGWEELEDNEKEQITQHIADLSSKAAGTPKKKAVVQAKLTTTGQVTSPVKGASFVTSTNPRKFSGFSAKPNNSGEAPSSPTPKRSLSSSKCDPRHKDCLLREFRKLCAMVADNPSYNTKTQIIQDFLRKGSAGDGFHGDVYLTVKLLLPGVIKTVYNLNDKQIVKLFSRIFNCNPDDMARDLEQGDVSETIRVFFEQSKSFPPAAKSLLTIQEVDEFLLRLSKLTKEDEQQQALQDIASRCTANDLKCIIRLIKHDLKMNSGAKHVLDALDPNAYEAFKASRNLQDVVERVLHNAQEVEKEPGQRRALSVQASLMTPVQPMLAEACKSVEYAMKKCPNGMFSEIKYDGERVQVHKNGDHFSYFSRSLKPVLPHKVAHFKDYIPQAFPGGHSMILDSEVLLIDNKTGKPLPFGTLGVHKKAAFQDANVCLFVFDCIYFNDVSLMDRPLCERRKFLHDNMVEIPNRIMFSEMKRVTKALDLADMITRVIQEGLEGLVLKDVKGTYEPGKRHWLKVKKDYLNEGAMADTADLVVLGAFYGQGSKGGMMSIFLMGCYDPGSQKWCTVTKCAGGHDDATLARLQNELDMVKISKDPSKIPSWLKVNKIYYPDFIVPDPKKAAVWEITGAEFSKSEAHTADGISIRFPRCTRIRDDKDWKSATNLPQLKELYQLSKEKADFTVVAGDEGSSTTGGSSEENKGPSGSAVSRKAPSKPSASTKKAEGKLSNSNSKDGNMQTAKPSAMKVGEKLATKSSPVKVGEKRKAADETLCQTKVLLDIFTGVRLYLPPSTPDFSRLRRYFVAFDGDLVQEFDMTSATHVLGSRDKNPAAQQVSPEWIWACIRKRRLVAPC

SEQ ID NO: 306 - protein, 1059 aa, Homo sapiens
MVDVLLLFSLCLLFHISRPDLSHNRLSFIKASSMSHLQSLREVKLNNNELETIPNLGPVSANITLLSLAGNRIVEILPEHLKEFQSLETLDLSSNNISELQTAFPALQLKYLYLNSNRVTSMEPGYFDNLANTLLVLKLNRNRISAIPPKMFKLPQLQHLELNRNKIKNVDGLTFQGLGALKSLKMQRNGVTKLMDGAFWGLSNMEILQLDHNNLTEITKGWLYGLLMLQELHLSQNAINRISPDAWEFCQKLSELDLTFNHLSRLDDSSFLGLSLLNTLHIGNNRVSYIADCAFRGLSSLKTLDLKNNEISWTIEDMNGAFSGLDKLRRLILQGNRIRSITKKAFTGLDALEHLDLSDNAIMSLQGNAFSQMKKLQQLHLNTSSLLCDCQLKWLPQWVAENNFQSFVNASCAHPQLLKGRSIFAVSPDGFVCDDFPKPQITVQPETQSAIKGSNLSFICSAASSSDSPMTFAWKKDNELLHDAEMENYAHLRAQGGEVMEYTTILRLREVEFASEGKYQCVISNHFGSSYSVKAKLTVNMLPSFTKTPMDLTIRAGAMARLECAAVGHPAPQIAWQKDGGTDFPAARERRMHVMPEDDVFFIVDVKIEDIGVYSCTAQNSAGSISANATLTVLETPSFLRPLLDRTVTKGETAVLQCIAGGSPPPKLNWTKDDSPLVVTERHFFAAGNQLLIIVDSDVSDAGKYTCEMSNTLGTERGNVRLSVIPTPTCDSPQMTAPSLDDDGWATVGVVIIAVVCCVVGTSLVWVVIIYHTRRRNEDCSITNTDETNLPADIPSYLSSQGTLADRQDGYVSSESGSHHQFVTSSGAGFFLPQHDSSGTCHIDNSSEADVEAATDLFLCPFLGSTGPMYLKGNVYGSDPFETYHTGCSPDPRTVLMDHYEPSYIKKKECYPCSHPSEESCERSFSNISWPSHVRKLLNTSYSHNEGPGMKNLCLNKSSLDFSANPEPASVASSNSFMGTFGKALRRPHLDAYSSFGQPSDCQPRAFYLKAHSSPDLDSGSEEDGKERTDFQEENHICTFKQTLENYRTPNFQSYDLDT

SEQ ID NO: 307 - protein, 916 aa, Homo sapiens
MESGQPARRIAMAPLLEYERQLVLELLDTDGLVVCARGLGADRLLYHFLQLHCHPACLVLVLNTQPAEEEYFINQLKIEGVEHLPRRVTNEITSNSRYEVYTQGGVIFATSRILVVDFLTDRIPSDLITGILVYRAHRIIESCQEAFILRLFRQKNKRGFIKAFTDNAVAFDTGFCHVERVMRNLFVRKLYLWPRFHVAVNSFLEQHKPEVVEIHVSMTPTMLAIQTAILDILNACLKELKCHNPSLEVEDLSLENAIGKPFDKTIRHYLDPLWHQLGAKTKSLVQDLKILRTLLQYLSQYDCVTFLNLLESLRATEKAFGQNSGWLFLDSSTSMFINARARVYHLPDAKMSKKEKISEKMEIKEGEETKKELVLESNPKWEALTEVLKEIEAENKESEALGGPGQVLICASDDRTCSQLRDYITLGAEAFLLRLYRKTFEKDSKAEEVWMKFRKEDSSKRIRKSHKRPKDPQNKERASTKERTLKKKKRKLTLTQMVGKPEELEEEGDVEEGYRREISSSPESCPEEIKHEEFDVNLSSDAAFGILKEPLTIIHPLLGCSDPYALTRVLHEVEPRYVVLYDAELTFVRQLEIYRASRPGKPLRVYFLIYGGSTEEQRYLTALRKEKEAFEKLIREKASMVVPEEREGRDETNLDLVRGTASADVSTDTRKAGGQEQNGTQQSIVVDMREFRSELPSLIHRRGIDIEPVTLEVGDYILTPEMCVERKSISDLIGSLNNGRLYSQCISMSRYYKRPVLLIEFDPSKPFSLTSRGALFQEISSNDISSKLTLLTLHFPRLRILWCPSPHATAELFEELKQSKPQPDAATALAITADSETLPESEKYNPGPQDFLLKMPGVNAKNCRSLMHHVKNIAELAALSQDELTSILGNAANAKQLYDFIHTSFAEVVSKGKGKK

SEQ ID NO: 308 - protein, 297 aa, Homo sapiens
MDPGKDKEGVPQPSGPPARKKFVIPLDEDEVPPGVAKPLFRSTQSLPTVDTSAQAAPQTYAEYAISQPLEGAGATCPTGSEPLAGETPNQALKPGAKSNSIIVSPRQRGNPVLKFVRNVPWEFGDVIPDYVLGQSTCALFLSLRYHNLHPDYIHGRLQSLGKNFALRVLLVQVDVKDPQQALKELAKMCILADCTLILAWSPEEAGRYLETYKAYEQKPADLLMEKLEQDFVSRVTECLTTVKSVNKTDSQTLLTTFGSLEQLIAASREDLALCPGLGPQKARRLFDVLHEPFLKVP

SEQ ID NO: 309 - protein, 273 aa, Homo sapiens
MDPGKDKEGVPQPSGPPARKKFVIPLDEDEVPPGVAKPLFRSTQSLPTVDTSAQAAPQTYAEYAISQPLEGAGATCPTGSEPLAGETPNQALKPGAKSNSIIVSPRQRGNPVLKFVRNVPWEFGDVIPDYVLGQSTCALFLSLRYHNLHPDYIHGRLQSLGKNFALRVLLVQVDVKDPQQALKELAKMCILADCTLILAWSPEEAGRYLETYKAYEQKPADLLMEKLEQDFVSRSLEQLIAASREDLALCPGLGPQKARRLFDVLHEPFLKVP

SEQ ID NO: 310 - protein, 323 aa, Homo sapiens
MDPGKDKEGVPQPSGPPARKKFVIPLDEDEVPPGVAKPLFRSTQSLPTVDTSAQAAPQTYAEYAISQPLEGAGATCPTGSEPLAGETPNQALKPGAKSNSIIVSPRQRGNPVLKFVRNVPWEFGDVIPDYVLGQSTCALFLSLRYHNLHPDYIHGRLQSLGKNFALRVLLVQVDVKDPQQALKELAKMCILADCTLILAWSPEEAGRYLETYKAYEQKPADLLMEKLEQDFVSRVTECLTTVKSVNKTDSQTLLTTFGSLEQLIAASREDLALCPGLGPQKVRALGKNPRSWGKERAPNKHNLRPQSFKVKKEPKTRHSGFRL

SEQ ID NO: 311 - protein, 225 aa, Homo sapiens
MDPGKDKEGVPQPSGPPARKKFVIPLDEDEVPPGVRGNPVLKFVRNVPWEFGDVIPDYVLGQSTCALFLSLRYHNLHPDYIHGRLQSLGKNFALRVLLVQVDVKDPQQALKELAKMCILADCTLILAWSPEEAGRYLETYKAYEQKPADLLMEKLEQDFVSRVTECLTTVKSVNKTDSQTLLTTFGSLEQLIAASREDLALCPGLGPQKARRLFDVLHEPFLKVP

SEQ ID NO: 312 - protein, 919 aa, Homo sapiens
MQRSIMSFFHPKKEGKAKKPEKEASNSSRETEPPPKAALKEWNGVVSESDSPVKRPGRKAARVLGSEGEEEDEALSPAKGQKPALDCSQVSPPRPATSPENNASLSDTSPMDSSPSGIPKRRTARKQLPKRTIQEVLEEQSEDEDREAKRKKEEEEEETPKESLTEAEVATEKEGEDGDQPTTPPKPLKTSKAETPTESVSEPEVATKQELQEEEEQTKPPRRAPKTLSSFFTPRKPAVKKEVKEEEPGAPGKEGAAEGPLDPSGYNPAKNNYHPVEDACWKPGQKVPYLAVARTFEKIEEVSARLRMVETLSNLLRSVVALSPPDLLPVLYLSLNHLGPPQQGLELGVGDGVLLKAVAQATGRQLESVRAEAAEKGDVGLVAENSRSTQRLMLPPPPLTASGVFSKFRDIARLTGSASTAKKIDIIKGLFVACRHSEARFIARSLSGRLRLGLAEQSVLAALSQAVSLTPPGQEFPPAMVDAGKGKTAEARKTWLEEQGMILKQTFCEVPDLDRIIPVLLEHGLERLPEHCKLSPGIPLKPMLAHPTRGISEVLKRFEEAAFTCEYKYDGQRAQIHALEGGEVKIFSRNQEDNTGKYPDIISRIPKIKLPSVTSFILDTEAVAWDREKKQIQPFQVLTTRKRKEVDASEIQVQVCLYAFDLIYLNGESLVREPLSRRRQLLRENFVETEGEFVFATSLDTKDIEQIAEFLEQSVKDSCEGLMVKTLDVDATYEIAKRSHNWLKLKKDYLDGVGDTLDLVVIGAYLGRGKRAGRYGGFLLASYDEDSEELQAICKLGTGFSDEELEEHHQSLKALVLPSPRPYVRIDGAVIPDHWLDPSAVWEVKCADLSLSPIYPAARGLVDSDKGISLRFPRFIRVREDKQPEQATTSAQVACLYRKQSQIQNQQGEDSGSDPEDTY

SEQ ID NO: 313 - protein, 888 aa, Homo sapiens
MQRSIMAALKEWNGVVSESDSPVKRPGRKAARVLGSEGEEEDEALSPAKGQKPALDCSQVSPPRPATSPENNASLSDTSPMDSSPSGIPKRRTARKQLPKRTIQEVLEEQSEDEDREAKRKKEEEEETPKESLTEAEVATEKEGEDGDQPTTPPKPLKTSKAETPTESVSEPEVATKQELQEEEEQTKPPRRAPKTLSSFFTPRKPAVKKEVKEEEPGAPGKEGAAEGPLDPSGYNPAKNNYHPVEDACWKPGQKVPYLAVARTFEKIEEVSARLRMVETLSNLLRSVVALSPPDLLPVLYLSLNHLGPPQQGLELGVGDGVLLKAVAQATGRQLESVRAEAAEKGDVGLVAENSRSTQRLMLPPPPLTASGVFSKFRDIARLTGSASTAKKIDIIKGLFVACRHSEARFIARSLSGRLRLGLAEQSVLAALSQAVSLTPPGQEFPPAMVDAGKGKTAEARKTWLEEQGMILKQTFCEVPDLDRIIPVLLEHGLERLPEHCKLSPGIPLKPMLAHPTRGISEVLKRFEEAAFTCEYKYDGQRAQIHALEGGEVKIFSRNQEDNTGKYPDIISRIPKIKLPSVTSFILDTEAVAWDREKKQIQPFQVLTTRKRKEVDASEIQVQVCLYAFDLIYLNGESLVREPLSRRRQLLRENFVETEGEFVFATSLDTKDIEQIAEFLEQSVKDSCEGLMVKTLDVDATYEIAKRSHNWLKLKKDYLDGVGDTLDLVVIGAYLGRGKRAGRYGGFLLASYDEDSEELQAICKLGTGFSDEELEEHHQSLKALVLPSPRPYVRIDGAVIPDHWLDPSAVWEVKCADLSLSPIYPAARGLVDSDKGISLRFPRFIRVREDKQPEQATTSAQVACLYRKQSQIQNQQGEDSGSDPEDTY

SEQ ID NO: 314 - protein, 851 aa, Homo sapiens
MQRSIMSFFHPKKEGKAKKPEKEASNSSRETEPPPKAALKEWNGVVSESDSPVKRPGRKAARVLGSEGEEEDEALSPAKGQKPALDCSQVSPPRPATSPENNASLSDTSPMDSSPSGIPKRRTEAETPTESVSEPEVATKQELQEEEEQTKPPRRAPKTLSSFFTPRKPAVKKEVKEEEPGAPGKEGAAEGPLDPSGYNPAKNNYHPVEDACWKPGQKVPYLAVARTFEKIEEVSARLRMVETLSNLLRSVVALSPPDLLPVLYLSLNHLGPPQQGLELGVGDGVLLKAVAQATGRQLESVRAEAAEKGDVGLVAENSRSTQRLMLPPPPLTASGVFSKFRDIARLTGSASTAKKIDIIKGLFVACRHSEARFIARSLSGRLRLGLAEQSVLAALSQAVSLTPPGQEFPPAMVDAGKGKTAEARKTWLEEQGMILKQTFCEVPDLDRIIPVLLEHGLERLPEHCKLSPGIPLKPMLAHPTRGISEVLKRFEEAAFTCEYKYDGQRAQIHALEGGEVKIFSRNQEDNTGKYPDIISRIPKIKLPSVTSFILDTEAVAWDREKKQIQPFQVLTTRKRKEVDASEIQVQVCLYAFDLIYLNGESLVREPLSRRRQLLRENFVETEGEFVFATSLDTKDIEQIAEFLEQSVKDSCEGLMVKTLDVDATYEIAKRSHNWLKLKKDYLDGVGDTLDLVVIGAYLGRGKRAGRYGGFLLASYDEDSEELQAICKLGTGFSDEELEEHHQSLKALVLPSPRPYVRIDGAVIPDHWLDPSAVWEVKCADLSLSPIYPAARGLVDSDKGISLRFPRFIRVREDKQPEQATTSAQVACLYRKQSQIQNQQGEDSGSDPEDTY

SEQ ID NO: 315 - protein, 2590 aa, Homo sapiens
MNLLRRSGKRRRSESGSDSFSGSGGDSSASPQFLSGSVLSPPPGLGRCLKAAAAGECKPTVPDYERDKLLLANWGLPKAVLEKYHSFGVKKMFEWQAECLLLGQVLEGKNLVYSAPTSAGKTLVAELLILKRVLEMRKKALFILPFVSVAKEKKYYLQSLFQEVGIKVDGYMGSTSPSRHFSSLDIAVCTIERANGLINRLIEENKMDLLGMVVVDELHMLGDSHRGYLLELLLTKICYITRKSASCQADLASSLSNAVQIVGMSATLPNLELVASWLNAELYHTDFRPVPLLESVKVGNSIYDSSMKLVREFEPMLQVKGDEDHVVSLCYETICDNHSVLLFCPSKKWCEKLADIIAREFYNLHHQAEGLVKPSECPPVILEQKELLEVMDQLRRLPSGLDSVLQKTVPWGVAFHHAGLTFEERDIIEGAFRQGLIRVLAATSTLSSGVNLPARRVIIRTPIFGGRPLDILTYKQMVGRAGRKGVDTVGESILICKNSEKSKGIALLQGSLKPVRSCLQRREGEEVTGSMIRAILEIIVGGVASTSQDMHTYAACTFLAASMKEGKQGIQRNQESVQLGAIEACVMWLLENEFIQSTEASDGTEGKVYHPTHLGSATLSSSLSPADTLDIFADLQRAMKGFVLENDLHILYLVTPMFEDWTTIDWYRFFCLWEKLPTSMKRVAELVGVEEGFLARCVKGKVVARTERQHRQMAIHKRFFTSLVLLDLISEVPLREINQKYGCNRGQIQSLQQSAAVYAGMITVFSNRLGWHNMELLLSQFQKRLTFGIQRELCDLVRVSLLNAQRARVLYASGFHTVADLARANIVEVEVILKNAVPFKSARKAVDEEEEAVEERRNMRTIWVTGRKGLTEREAAALIVEEARMILQQDLVEMGVQWNPCALLHSSTCSLTHSESEVKEHTFISQTKSSYKKLTSKNKSNTIFSDSYIKHSPNIVQDLNKSREHTSSFNCNFQNGNQEHQTCSIFRARKRASLDINKEKPGASQNEGKTSDKKVVQTFSQKTKKAPLNFNSEKMSRSFRSWKRRKHLKRSRDSSPLKDSGACRIHLQGQTLSNPSLCEDPFTLDEKKTEFRNSGPFAKNVSLSGKEKDNKTSFPLQIKQNCSWNITLTNDNFVEHIVTGSQSKNVTCQATSVVSEKGRGVAVEAEKINEVLIQNGSKNQNVYMKHHDIHPINQYLRKQSHEQTSTITKQKNIIERQMPCEAVSSYINRDSNVTINCERIKLNTEENKPSHFQALGDDISRTVIPSEVLPSAGAFSKSEGQHENFLNISRLQEKTGTYTTNKTKNNHVSDLGLVLCDFEDSFYLDTQSEKIIQQMATENAKLGAKDTNLAAGIMQKSLVQQNSMNSFQKECHIPFPAEQHPLGATKIDHLDLKTVGTMKQSSDSHGVDILTPESPIFHSPILLEENGLFLKKNEVSVTDSQLNSFLQGYQTQETVKPVILLIPQKRTPTGVEGECLPVPETSLNMSDSLLFDSFSDDYLVKEQLPDMQMKEPLPSEVTSNHFSDSLCLQEDLIKKSNVNENQDTHQQLTCSNDESIIFSEMDSVQMVEALDNVDIFPVQEKNHTVVSPRALELSDPVLDEHHQGDQDGGDQDERAEKSKLTGTRQNHSFIWSGASFDLSPGLQRILDKVSSPLENEKLKSMTINFSSLNRKNTELNEEQEVISNLETKQVQGISFSSNNEVKSKIEMLENNANHDETSSLLPRKESNIVDDNGLIPPTPIPTSASKLTFPGILETPVNPWKTNNVLQPGESYLFGSPSDIKNHDLSPGSRNGFKDNSPISDTSFSLQLSQDGLQLTPASSSSESLSIIDVASDQNLFQTFIKEWRCKKRFSISLACEKIRSLTSSKTATIGSRFKQASSPQEIPIRDDGFPIKGCDDTLVVGLAVCWGGRDAYYFSLQKEQKHSEISASLVPPSLDPSLTLKDRMWYLQSCLRKESDKECSVVIYDFIQSYKILLLSCGISLEQSYEDPKVACWLLDPDSQEPTLHSIVTSFLPHELPLLEGMETSQGIQSLGLNAGSEHSGRYRASVESILIFNSMNQLNSLLQKENLQDVFRKVEMPSQYCLALLELNGIGFSTAECESQKHIMQAKLDAIETQAYQLAGHSFSFTSSDDIAEVLFLELKLPPNREMKNQGSKKTLGSTRRGIDNGRKLRLGRQFSTSKDVLNKLKALHPLPGLILEWRRITNAITKVVFPLQREKCLNPFLGMERIYPVSQSHTATGRITFTEPNIQNVPRDFEIKMPTLVGESPPSQAVGKGLLPMGRGKYKKGFSVNPRCQAQMEERAADRGMPFSISMRHAFVPFPGGSILAADYSQLELRILAHLSHDRRLIQVLNTGADVFRSIAAEWKMIEPESVGDDLRQQAKQICYGIIYGMGAKSLGEQMGIKENDAACYIDSFKSRYTGINQFMTETVKNCKRDGFVQTILGRRRYLPGIKDNNPYRKAHAERQAINTIVQGSAADIVKIATVNIQKQLETFHSTFKSHGHREGMLQSDQTGLSRKRKLQGMFCPIRGGFFILQLHDELLYEVAEEDVVQVAQIVKNEMESAVKLSVKLKVKVKIGASWGELKDFDV

SEQ ID NO: 316 - protein, 1762 aa, Homo sapiens
MNSFLSFPISLCSARKAVDEEEEAVEERRNMRTIWVTGRKGLTEREAAALIVEEARMILQQDLVEMGVQWNPCALLHSSTCSLTHSESEVKEHTFISQTKSSYKKLTSKNKSNTIFSDSYIKHSPNIVQDLNKSREHTSSFNCNFQNGNQEHQTCSIFRARKRASLDINKEKPGASQNEGKTSDKKVVQTFSQKTKKAPLNFNSEKMSRSFRSWKRRKHLKRSRDSSPLKDSGACRIHLQGQTLSNPSLCEDPFTLDEKKTEFRNSGPFAKNVSLSGKEKDNKTSFPLQIKQNCSWNITLTNDNFVEHIVTGSQSKNVTCQATSVVSEKGRGVAVEAEKINEVLIQNGSKNQNVYMKHHDIHPINQYLRKQSHEQTSTITKQKNIIERQMPCEAVSSYINRDSNVTINCERIKLNTEENKPSHFQALGDDISRTVIPSEVLPSAGAFSKSEGQHENFLNISRLQEKTGTYTTNKTKNNHVSDLGLVLCDFEDSFYLDTQSEKIIQQMATENAKLGAKDTNLAAGIMQKSLVQQNSMNSFQKECHIPFPAEQHPLGATKIDHLDLKTVGTMKQSSDSHGVDILTPESPIFHSPILLEENGLFLKKNEVSVTDSQLNSFLQGYQTQETVKPVILLIPQKRTPTGVEGECLPVPETSLNMSDSLLFDSFSDDYLVKEQLPDMQMKEPLPSEVTSNHFSDSLCLQEDLIKKSNVNENQDTHQQLTCSNDESIIFSEMDSVQMVEALDNVDIFPVQEKNHTVVSPRALELSDPVLDEHHQGDQDGGDQDERAEKSKLTGTRQNHSFIWSGASFDLSPGLQRILDKVSSPLENEKLKSMTINFSSLNRKNTELNEEQEVISNLETKQVQGISFSSNNEVKSKIEMLENNANHDETSSLLPRKESNIVDDNGLIPPTPIPTSASKLTFPGILETPVNPWKTNNVLQPGESYLFGSPSDIKNHDLSPGSRNGFKDNSPISDTSFSLQLSQDGLQLTPASSSSESLSIIDVASDQNLFQTFIKEWRCKKRFSISLACEKIRSLTSSKTATIGSRFKQASSPQEIPIRDDGFPIKGCDDTLVVGLAVCWGGRDAYYFSLQKEQKHSEISASLVPPSLDPSLTLKDRMWYLQSCLRKESDKECSVVIYDFIQSYKILLLSCGISLEQSYEDPKVACWLLDPDSQEPTLHSIVTSFLPHELPLLEGMETSQGIQSLGLNAGSEHSGRYRASVESILIFNSMNQLNSLLQKENLQDVFRKVEMPSQYCLALLELNGIGFSTAECESQKHIMQAKLDAIETQAYQLAGHSFSFTSSDDIAEVLFLELKLPPNREMKNQGSKKTLGSTRRGIDNGRKLRLGRQFSTSKDVLNKLKALHPLPGLILEWRRITNAITKVVFPLQREKCLNPFLGMERIYPVSQSHTATGRITFTEPNIQNVPRDFEIKMPTLVGESPPSQAVGKGLLPMGRGKYKKGFSVNPRCQAQMEERAADRGMPFSISMRHAFVPFPGGSILAADYSQLELRILAHLSHDRRLIQVLNTGADVFRSIAAEWKMIEPESVGDDLRQQAKQICYGIIYGMGAKSLGEQMGIKENDAACYIDSFKSRYTGINQFMTETVKNCKRDGFVQTILGRRRYLPGIKDNNPYRKAHAERQAINTIVQGSAADIVKIATVNIQKQLETFHSTFKSHGHREGMLQSDQTGLSRKRKLQGMFCPIRGGFFILQLHDELLYEVAEEDVVQVAQIVKNEMESAVKLSVKLKVKVKIGASWGELKDFDV

SEQ ID NO: 317 - protein, 633 aa, Homo sapiens
MPEIRLRHVVSCSSQDSTHCAENLLKADTYRKWRAAKAGEKTISVVLQLEKEEQIHSVDIGNDGSAFVEVLVGSSAGGAGEQDYEVLLVTSSFMSPSESRSGSNPNRVRMFGPDKLVRAAAEKRWDRVKIVCSQPYSKDSPFGLSFVRFHSPPDKDEAEAPSQKVTVTKLGQFRVKEEDESANSLRPGALFFSRINKTSPVTASDPAGPSYAAATLQASSAASSASPVSRAIGSTSKPQESPKGKRKLDLNQEEKKTPSKPPAQLSPSVPKRPKLPAPTRTPATAPVPARAQGAVTGKPRGEGTEPRRPRAGPEELGKILQGVVVVLSGFQNPFRSELRDKALELGAKYRPDWTRDSTHLICAFANTPKYSQVLGLGGRIVRKEWVLDCHRMRRRLPSRRYLMAGPGSSSEEDEASHSGGSGDEAPKLPQKQPQTKTKPTQAAGPSSPQKPPTPEETKAASPVLQEDIDIEGVQSEGQDNGAEDSGDTEDELRRVAEQKEHRLPPGQEENGEDPYAGSTDENTDSEEHQEPPDLPVPELPDFFQGKHFFLYGEFPGDERRKLIRYVTAFNGELEDNMSDRVQFVITAQEWDPSFEEALMDNPSLAFVRPRWIYSCNEKQKLLPHQLYGVVPQA

SEQ ID NO: 318 - protein, 1720 aa, Homo sapiens
MLISKNMPWRRLQGISFGMYSAEELKKLSVKSITNPRYLDSLGNPSANGLYDLALGPADSKEVCSTCVQDFSNCSGHLGHIELPLTVYNPLLFDKLYLLLRGSCLNCHMLTCPRAVIHLLLCQLRVLEVGALQAVYELERILNRFLEENPDPSASEIREELEQYTTEIVQNNLLGSQGAHVKNVCESKSKLIALFWKAHMNAKRCPHCKTGRSVVRKEHNSKLTITFPAMVHRTAGQKDSEPLGIEEAQIGKRGYLTPTSAREHLSALWKNEGFFLNYLFSGMDDDGMESRFNPSVFFLDFLVVPPSRYRPVSRLGDQMFTNGQTVNLQAVMKDVVLIRKLLALMAQEQKLPEEVATPTTDEEKDSLIAIDRSFLSTLPGQSLIDKLYNIWIRLQSHVNIVFDSEMDKLMMDKYPGIRQILEKKEGLFRKHMMGKRVDYAARSVICPDMYINTNEIGIPMVFATKLTYPQPVTPWNVQELRQAVINGPNVHPGASMVINEDGSRTALSAVDMTQREAVAKQLLTPATGAPKPQGTKIVCRHVKNGDILLLNRQPTLHRPSIQAHRARILPEEKVLRLHYANCKAYNADFDGDEMNAHFPQSELGRAEAYVLACTDQQYLVPKDGQPLAGLIQDHMVSGASMTTRGCFFTREHYMELVYRGLTDKVGRVKLLSPSILKPFPLWTGKQVVSTLLINIIPEDHIPLNLSGKAKITGKAWVKETPRSVPGFNPDSMCESQVIIREGELLCGVLDKAHYGSSAYGLVHCCYEIYGGETSGKVLTCLARLFTAYLQLYRGFTLGVEDILVKPKADVKRQRIIEESTHCGPQAVRAALNLPEAASYDEVRGKWQDAHLGKDQRDFNMIDLKFKEEVNHYSNEINKACMPFGLHRQFPENSLQMMVQSGAKGSTVNTMQISCLLGQIELEGRRPPLMASGKSLPCFEPYEFTPRAGGFVTGRFLTGIKPPEFFFHCMAGREGLVDTAVKTSRSGYLQRCIIKHLEGLVVQYDLTVRDSDGSVVQFLYGEDGLDIPKTQFLQPKQFPFLASNYEVIMKSQHLHEVLSRADPKKALHHFRAIKKWQSKHPNTLLRRGAFLSYSQKIQEAVKALKLESENRNGRSPGTQEMLRMWYELDEESRRKYQKKAAACPDPSLSVWRPDIYFASVSETFETKVDDYSQEWAAQTEKSYEKSELSLDRLRTLLQLKWQRSLCEPGEAVGLLAAQSIGEPSTQMTLNTFHFAGRGEMNVTLGIPRLREILMVASANIKTPMMSVPVLNTKKALKRVKSLKKQLTRVCLGEVLQKIDVQESFCMEEKQNKFQVYQLRFQFLPHAYYQQEKCLRPEDILRFMETRFFKLLMESIKKKNNKASAFRNVNTRRATQRDLDNAGELGRSRGEQEGDEEEEGHIVDAEAEEGDADASDAKRKEKQEEEVDYESEEEEEREGEENDDEDMQEERNPHREGARKTQEQDEEVGLGTEEDPSLPALLTQPRKPTHSQEPQGPEAMERRVQAVREIHPFIDDYQYDTEESLWCQVTVKLPLMKINFDMSSLVVSLAHGAVIYATKGITRCLLNETTNNKNEKELVLNTEGINLPELFKYAEVLDLRRLYSNDIHAIANTYGIEAALRVIEKEIKDVFAVYGIAVDPRHLSLVADYMCFEGVYKPLNRFGIRSNSSPLQQMTFETSFQFLKQATMLGSHDELRSPSACLVVGKVVRGGTGLFELKQPLR

SEQ ID NO: 319 - protein, 270 aa, Homo sapiens
MWNSGFESYGSSSYGGAGGYTQSPGGFGSPAPSQAEKKSRARAQHIVPCTISQLLSATLVDEVFRIGNVEISQVTIVGIIRHAEKAPTNIVYKIDDMTAAPMDVRQWVDTDDTSSENTVVPPETYVKVAGHLRSFQNKKSLVAFKIMPLEDMNEFTTHILEVINAHMVLSKANSQPSAGRAPISNPGMSEAGNFGGNSFMPANGLTVAQNQVLNLIKACPRPEGLNFQDLKNQLKHMSVSSIKQAVDFLSNEGHIYSTVDDDHFKSTDAE

SEQ ID NO: 320 - protein, 278 aa, Homo sapiens
MGRGDRNKRSIRGFESYGSSSYGGAGGYTQSPGGFGSPAPSQAEKKSRARAQHIVPCTISQLLSATLVDEVFRIGNVEISQVTIVGIIRHAEKAPTNIVYKIDDMTAAPMDVRQWVDTDDTSSENTVVPPETYVKVAGHLRSFQNKKSLVAFKIMPLEDMNEFTTHILEVINAHMVLSKANSQPSAGRAPISNPGMSEAGNFGGNSFMPANGLTVAQNQVLNLIKACPRPEGLNFQDLKNQLKHMSVSSIKQAVDFLSNEGHIYSTVDDDHFKSTDAE

SEQ ID NO: 321 - protein, 358 aa, Homo sapiens
MWNSNDGGAGWRRKRIAGGFSKRASLGSERRVVAGEEGRERSWGVWGSPAGRRRGRLGRLGQCLKGRSLREPAGFSEAWDVAQALILLFKTGGFESYGSSSYGGAGGYTQSPGGFGSPAPSQAEKKSRARAQHIVPCTISQLLSATLVDEVFRIGNVEISQVTIVGIIRHAEKAPTNIVYKIDDMTAAPMDVRQWVDTDDTSSENTVVPPETYVKVAGHLRSFQNKKSLVAFKIMPLEDMNEFTTHILEVINAHMVLSKANSQPSAGRAPISNPGMSEAGNFGGNSFMPANGLTVAQNQVLNLIKACPRPEGLNFQDLKNQLKHMSVSSIKQAVDFLSNEGHIYSTVDDDHFKSTDAE

SEQ ID NO: 322 - protein, 418 aa, Homo sapiens
MSGTEEAILGGRDSHPAAGGGSVLCFGQCQYTAEEYQAIQKALRQRLGPEYISSRMAGGGQKVCYIEGHRVINLANEMFGYNGWAHSITQQNVDFVDLNNGKFYVGVCAFVRVQLKDGSYHEDVGYGVSEGLKSKALSLEKARKEAVTDGLKRALRSFGNALGNCILDKDYLRSLNKLPRQLPLEVDLTKAKRQDLEPSVEEARYNSCRPNMALGHPQLQQVTSPSRPSHAVIPADQDCSSRSLSSSAVESEATHQRKLRQKQLQQQFRERMEKQQVRVSTPSAEKSEAAPPAPPVTHSTPVTVSEPLLEKDFLAGVTQELIKTLEDNSEKWAVTPDAGDGVVKPSSRADPAQTSDTLALNNQMVTQNRTPHSVCHQKPQAKSGSWDLQTYSADQRTTGNWESHRKSQDMKKRKYDPS

SEQ ID NO: 323 - protein, 226 aa, Homo sapiens
MSGTEEAILGGRDSHPAAGGGSVLCFGQCQYTAEEYQAIQKALRQRLGPEYISSRMAGGGQKVCYIEGHRVINLANEMFGYNGWAHSITQQNVDFVDLNNGKFYVGVCAFVRVQLKDGSYHEDVGYGVSEGLKSKALSLEKARKEAVTDGLKRALRLPLLGVSGRILYSLFSVHSVMCAGGLPTPTASAQTAPSSPCSSAVLRYAQEFWECTWKLYSGQRLPEITK

SEQ ID NO: 324 - protein, 139 aa, Homo sapiens
MSGTEEAILGGRDSHPAAGGGSVLCFGQCQYTAEEYQAIQKALRQRLGPEYISSRMAGGGQKVCYIEGHRVINLANEMFGYNGWAHSITQQNVDFVDLNNGKFYVGVCAFVRVQLKVRGWSRPAARKDQWVVGEGWFIS

SEQ ID NO: 325 - protein, 118 aa, Homo sapiens
MSGTEEAILGGRDSHPAAGGGSVLCFGQCQYTAEEYQAIQKALRQRLGPEYISSRMAGGGQKVCYIEGHRVINLANEMFGYNGWAHSITQQNVGEYALQQWGLLHCPAPAESLLWVRR

SEQ ID NO: 326 - protein, 976 aa, Homo sapiens
MNAGPGCEPCTKRPRWGAATTSPAASDARSFPSRQRRVLDPKDAHVQFRVPPSSPACVPGRAGQHRGSATSLVFKQKTITSWMDTKGIKTAESESLDSKENNNTRIESMMSSVQKDNFYQHNVEKLENVSQLSLDKSPTEKSTQYLNQHQTAAMCKWQNEGKHTEQLLESEPQTVTLVPEQFSNANIDRSPQNDDHSDTDSEENRDNQQFLTTVKLANAKQTTEDEQAREAKSHQKCSKSCDPGEDCASCQQDEIDVVPESPLSDVGSEDVGTGPKNDNKLTRQESCLGNSPPFEKESEPESPMDVDNSKNSCQDSEADEETSPGFDEQEDGSSSQTANKPSRFQARDADIEFRKRYSTKGGEVRLHFQFEGGESRTGMNDLNAKLPGNISSLNVECRNSKQHGKKDSKITDHFMRLPKAEDRRKEQWETKHQRTERKIPKYVPPHLSPDKKWLGTPIEEMRRMPRCGIRLPLLRPSANHTVTIRVDLLRAGEVPKPFPTHYKDLWDNKHVKMPCSEQNLYPVEDENGERTAGSRWELIQTALLNKFTRPQNLKDAILKYNVAYSKKWDFTALIDFWDKVLEEAEAQHLYQSILPDMVKIALCLPNICTQPIPLLKQKMNHSITMSQEQIASLLANAFFCTFPRRNAKMKSEYSSYPDINFNRLFEGRSSRKPEKLKTLFCYFRRVTEKKPTGLVTFTRQSLEDFPEWERCEKPLTRLHVTYEGTIEENGQGMLQVDFANRFVGGGVTSAGLVQEEIRFLINPELIISRLFTEVLDHNECLIITGTEQYSEYTGYAETYRWSRSHEDGSERDDWQRRCTEIVAIDALHFRRYLDQFVPEKMRRELNKAYCGFLRPGVSSENLSAVATGNWGCGAFGGDARLKALIQILAAAAAERDVVYFTFGDSELMRDIYSMHIFLTERKLTVGDVYKLLLRYYNEECRNCSTPGPDIKLYPFIYHAVESCAETADHSGQRTGT

SEQ ID NO: 327 - protein, 894 aa, Homo sapiens
MDTKGIKTAESESLDSKENNNTRIESMMSSVQKDNFYQHNVEKLENVSQLSLDKSPTEKSTQYLNQHQTAAMCKWQNEGKHTEQLLESEPQTVTLVPEQFSNANIDRSPQNDDHSDTDSEENRDNQQFLTTVKLANAKQTTEDEQAREAKSHQKCSKSCDPGEDCASCQQDEIDVVPESPLSDVGSEDVGTGPKNDNKLTRQESCLGNSPPFEKESEPESPMDVDNSKNSCQDSEADEETSPGFDEQEDGSSSQTANKPSRFQARDADIEFRKRYSTKGGEVRLHFQFEGGESRTGMNDLNAKLPGNISSLNVECRNSKQHGKKDSKITDHFMRLPKAEDRRKEQWETKHQRTERKIPKYVPPHLSPDKKWLGTPIEEMRRMPRCGIRLPLLRPSANHTVTIRVDLLRAGEVPKPFPTHYKDLWDNKHVKMPCSEQNLYPVEDENGERTAGSRWELIQTALLNKFTRPQNLKDAILKYNVAYSKKWDFTALIDFWDKVLEEAEAQHLYQSILPDMVKIALCLPNICTQPIPLLKQKMNHSITMSQEQIASLLANAFFCTFPRRNAKMKSEYSSYPDINFNRLFEGRSSRKPEKLKTLFCYFRRVTEKKPTGLVTFTRQSLEDFPEWERCEKPLTRLHVTYEGTIEENGQGMLQVDFANRFVGGGVTSAGLVQEEIRFLINPELIISRLFTEVLDHNECLIITGTEQYSEYTGYAETYRWSRSHEDGSERDDWQRRCTEIVAIDALHFRRYLDQFVPEKMRRELNKAYCGFLRPGVSSENLSAVATGNWGCGAFGGDARLKALIQILAAAAAERDVVYFTFGDSELMRDIYSMHIFLTERKLTVGDVYKLLLRYYNEECRNCSTPGPDIKLYPFIYHAVESCAETADHSGQRTGT

SEQ ID NO: 328 - protein, 868 aa, Homo sapiens
MMSSVQKDNFYQHNVEKLENVSQLSLDKSPTEKSTQYLNQHQTAAMCKWQNEGKHTEQLLESEPQTVTLVPEQFSNANIDRSPQNDDHSDTDSEENRDNQQFLTTVKLANAKQTTEDEQAREAKSHQKCSKSCDPGEDCASCQQDEIDVVPESPLSDVGSEDVGTGPKNDNKLTRQESCLGNSPPFEKESEPESPMDVDNSKNSCQDSEADEETSPGFDEQEDGSSSQTANKPSRFQARDADIEFRKRYSTKGGEVRLHFQFEGGESRTGMNDLNAKLPGNISSLNVECRNSKQHGKKDSKITDHFMRLPKAEDRRKEQWETKHQRTERKIPKYVPPHLSPDKKWLGTPIEEMRRMPRCGIRLPLLRPSANHTVTIRVDLLRAGEVPKPFPTHYKDLWDNKHVKMPCSEQNLYPVEDENGERTAGSRWELIQTALLNKFTRPQNLKDAILKYNVAYSKKWDFTALIDFWDKVLEEAEAQHLYQSILPDMVKIALCLPNICTQPIPLLKQKMNHSITMSQEQIASLLANAFFCTFPRRNAKMKSEYSSYPDINFNRLFEGRSSRKPEKLKTLFCYFRRVTEKKPTGLVTFTRQSLEDFPEWERCEKPLTRLHVTYEGTIEENGQGMLQVDFANRFVGGGVTSAGLVQEEIRFLINPELIISRLFTEVLDHNECLIITGTEQYSEYTGYAETYRWSRSHEDGSERDDWQRRCTEIVAIDALHFRRYLDQFVPEKMRRELNKAYCGFLRPGVSSENLSAVATGNWGCGAFGGDARLKALIQILAAAAAERDVVYFTFGDSELMRDIYSMHIFLTERKLTVGDVYKLLLRYYNEECRNCSTPGPDIKLYPFIYHAVESCAETADHSGQRTGT

SEQ ID NO: 329 - protein, 527 aa, Homo sapiens
MVQAGAEKDAQSISLRKEQWETKHQRTERKIPKYVPPHLSPDKKWLGTPIEEMRRMPRCGIRLPLLRPSANHTVTIWNGERTAGSRWELIQTALLNKFTRPQNLKDAILKYNVAYSKKWDFTALIDFWDKVLEEAEAQHLYQSILPDMVKIALCLPNICTQPIPLLKQKMNHSITMSQEQIASLLANAFFCTFPRRNAKMKSEYSSYPDINFNRLFEGRSSRKPEKLKTLFCYFRRVTEKKPTGLVTFTRQSLEDFPEWERCEKPLTRLHVTYEGTIEENGQGMLQVDFANRFVGGGVTSAGLVQEEIRFLINPELIISRLFTEVLDHNECLIITGTEQYSEYTGYAETYRWSRSHEDGSERDDWQRRCTEIVAIDALHFRRYLDQFVPEKMRRELNKAYCGFLRPGVSSENLSAVATGNWGCGAFGGDARLKALIQILAAAAAERDVVYFTFGDSELMRDIYSMHIFLTERKLTVGDVYKLLLRYYNEECRNCSTPGPDIKLYPFIYHAVESCAETADHSGQRTGT

SEQ ID NO: 330 - protein, 475 aa, Homo sapiens
MRRMPRCGIRLPLLRPSANHTVTIWNGERTAGSRWELIQTALLNKFTRPQNLKDAILKYNVAYSKKWDFTALIDFWDKVLEEAEAQHLYQSILPDMVKIALCLPNICTQPIPLLKQKMNHSITMSQEQIASLLANAFFCTFPRRNAKMKSEYSSYPDINFNRLFEGRSSRKPEKLKTLFCYFRRVTEKKPTGLVTFTRQSLEDFPEWERCEKPLTRLHVTYEGTIEENGQGMLQVDFANRFVGGGVTSAGLVQEEIRFLINPELIISRLFTEVLDHNECLIITGTEQYSEYTGYAETYRWSRSHEDGSERDDWQRRCTEIVAIDALHFRRYLDQFVPEKMRRELNKAYCGFLRPGVSSENLSAVATGNWGCGAFGGDARLKALIQILAAAAAERDVVYFTFGDSELMRDIYSMHIFLTERKLTVGDVYKLLLRYYNEECRNCSTPGPDIKLYPFIYHAVESCAETADHSGQRTGT

SEQ ID NO: 331 - protein, 2286 aa, Homo sapiens
MSLRSGGRRRADPGADGEASRDDGATSSVSALKRLERSQWTDKMDLRFGFERLKEPGEKTGWLINMHPTEILDEDKRLGSAVDYYFIQDDGSRFKVALPYKPYFYIATRKGCEREVSSFLSKKFQGKIAKVETVPKEDLDLPNHLVGLKRNYIRLSFHTVEDLVKVRKEISPAVKKNREQDHASDAYTALLSSVLQRGGVITDEEETSKKIADQLDNIVDMREYDVPYHIRLSIDLKIHVAHWYNVRYRGNAFPVEITRRDDLVERPDPVVLAFDIETTKLPLKFPDAETDQIMMISYMIDGQGYLITNREIVSEDIEDFEFTPKPEYEGPFCVFNEPDEAHLIQRWFEHVQETKPTIMVTYNGDFFDWPFVEARAAVHGLSMQQEIGFQKDSQGEYKAPQCIHMDCLRWVKRDSYLPVGSHNLKAAAKAKLGYDPVELDPEDMCRMATEQPQTLATYSVSDAVATYYLYMKYVHPFIFALCTIIPMEPDEVLRKGSGTLCEALLMVQAFHANIIFPNKQEQEFNKLTDDGHVLDSETYVGGHVEALESGVFRSDIPCRFRMNPAAFDFLLQRVEKTLRHALEEEEKVPVEQVTNFEEVCDEIKSKLASLKDVPSRIECPLIYHLDVGAMYPNIILTNRLQPSAMVDEATCAACDFNKPGANCQRKMAWQWRGEFMPASRSEYHRIQHQLESEKFPPLFPEGPARAFHELSREEQAKYEKRRLADYCRKAYKKIHITKVEERLTTICQRENSFYVDTVRAFRDRRYEFKGLHKVWKKKLSAAVEVGDAAEVKRCKNMEVLYDSLQLAHKCILNSFYGYVMRKGARWYSMEMAGIVCFTGANIITQARELIEQIGRPLELDTDGIWCVLPNSFPENFVFKTTNVKKPKVTISYPGAMLNIMVKEGFTNDQYQELAEPSSLTYVTRSENSIFFEVDGPYLAMILPASKEEGKKLKKRYAVFNEDGSLAELKGFEVKRRGELQLIKIFQSSVFEAFLKGSTLEEVYGSVAKVADYWLDVLYSKAANMPDSELFELISENRSMSRKLEDYGEQKSTSISTAKRLAEFLGDQMVKDAGLSCRYIISRKPEGSPVTERAIPLAIFQAEPTVRKHFLRKWLKSSSLQDFDIRAILDWDYYIERLGSAIQKIITIPAALQQVKNPVPRVKHPDWLHKKLLEKNDVYKQKKISELFTLEGRRQVTMAEASEDSPRPSAPDMEDFGLVKLPHPAAPVTVKRKRVLWESQEESQDLTPTVPWQEILGQPPALGTSQEEWLVWLRFHKKKWQLQARQRLARRKRQRLESAEGVLRPGAIRDGPATGLGSFLRRTARSILDLPWQIVQISETSQAGLFRLWALVGSDLHCIRLSIPRVFYVNQRVAKAEEGASYRKVNRVLPRSNMVYNLYEYSVPEDMYQEHINEINAELSAPDIEGVYETQVPLLFRALVHLGCVCVVNKQLVRHLSGWEAETFALEHLEMRSLAQFSYLEPGSIRHIYLYHHAQAHKALFGIFIPSQRRASVFVLDTVRSNQMPSLGALYSAEHGLLLEKVGPELLPPPKHTFEVRAETDLKTICRAIQRFLLAYKEERRGPTLIAVQSSWELKRLASEIPVLEEFPLVPICVADKINYGVLDWQRHGARRMIRHYLNLDTCLSQAFEMSRYFHIPIGNLPEDISTFGSDLFFARHLQRHNHLLWLSPTARPDLGGKEADDNCLVMEFDDQATVEINSSGCYSTVCVELDLQNLAVNTILQSHHVNDMEGADSMGISFDVIQQASLEDMITGGQAASAPASYDETALCSNTFRILKSMVVGWVKEITQYHNIYADNQVMHFYRWLRSPSSLLHDPALHRTLHNMMKKLFLQLIAEFKRLGSSVIYANFNRIILCTKKRRVEDAIAYVEYITSSIHSKETFHSLTISFSRCWEFLLWMDPSNYGGIKGKVSSRIHCGLQDSQKAGGAEDEQENEDDEEERDGEEEEEAEESNVEDLLENNWNILQFLPQAASCQNYFLMIVSAYIVAVYHCMKDGLRRSAPGSTPVRRRGASQLSQEAEGAVGALPGMITFSQDYVANELTQSFFTITQKIQKKVTGSRNSTELSEMFPVLPGSHLLLNNPALEFIKYVCKVLSLDTNITNQVNKLNRDLLRLVDVGEFSEEAQFRDPCRSYVLPEVICRSCNFCRDLDLCKDSSFSEDGAVLPQWLCSNCQAPYDSSAIEMTLVEVLQKKLMAFTLQDLVCLKCRGVKETSMPVYCSCAGDFALTIHTQVFMEQIGIFRNIAQHYGMSYLLETLEWLLQKNPQLGH

SEQ ID NO: 332 - protein, 469 aa, Homo sapiens
MFSEQAAQRAHTLLSPPSANNATFARVPVATYTNSSQPFRLGERSFSRQYAHIYATRLIQMRPFLENRAQQHWGSGVGVKKLCELQPEEKCCVVGTLFKAMPLQPSILREVSEEHNLLPQPPRSKYIHPDDELVLEDELQRIKLKGTIDVSKLVTGTVLAVFGSVRDDGKFLVEDYCFADLAPQKPAPPLDTDRFVLLVSGLGLGGGGGESLLGTQLLVDVVTGQLGDEGEQCSAAHVSRVILAGNLLSHSTQSRDSINKAKYLTKKTQAASVEAVKMLDEILLQLSASVPVDVMPGEFDPTNYTLPQQPLHPCMFPLATAYSTLQLVTNPYQATIDGVRFLGTSGQNVSDIFRYSSMEDHLEILEWTLRVRHISPTAPDTLGCYPFYKTDPFIFPECPHVYFCGNTPSFGSKIIRGPEDQTVLLVTVPDFSATQTACLVNLRSLACQPISFSGFGAEDDDLGGLGLGP

SEQ ID NO: 333 - protein, 504 aa, Homo sapiens
MGGAGARGLAGCGAPRVNLLGLGEAVWTKQVRSVAMFSEQAAQRAHTLLSPPSANNATFARVPVATYTNSSQPFRLGERSFSRQYAHIYATRLIQMRPFLENRAQQHWGSGVGVKKLCELQPEEKCCVVGTLFKAMPLQPSILREVSEEHNLLPQPPRSKYIHPDDELVLEDELQRIKLKGTIDVSKLVTGTVLAVFGSVRDDGKFLVEDYCFADLAPQKPAPPLDTDRFVLLVSGLGLGGGGGESLLGTQLLVDVVTGQLGDEGEQCSAAHVSRVILAGNLLSHSTQSRDSINKAKYLTKKTQAASVEAVKMLDEILLQLSASVPVDVMPGEFDPTNYTLPQQPLHPCMFPLATAYSTLQLVTNPYQATIDGVRFLGTSGQNVSDIFRYSSMEDHLEILEWTLRVRHISPTAPDTLGCYPFYKTDPFIFPECPHVYFCGNTPSFGSKIIRGPEDQTVLLVTVPDFSATQTACLVNLRSLACQPISFSGFGAEDDDLGGLGLGP

SEQ ID NO: 334 - protein, 466 aa, Homo sapiens
MADQLYLENIDEFVTDQNKIVTYKWLSYTLGVHVNQAKQMLYDYVERKRKENSGAQLHVTYLVSGSLIQNGHSCHKVAVVREDKLEAVKSKLAVTASIHVYSIQKAMLKDSGPLFNTDYDILKSNLQNCSKFSAIQCAAAVPRAPAESSSSSKKFEQSHLHMSSETQANNELTTNGHGPPASKQVSQQPKGIMGMFASKAAAKTQETNKETKTEAKEVTNASAAGNKAPGKGNMMSNFFGKAAMNKFKVNLDSEQAVKEEKIVEQPTVSVTEPKLATPAGLKKSSKKAEPVKVLQKEKKRGKRVALSDDETKETENMRKKRRRIKLPESDSSEDEVFPDSPGAYEAESPSPPPPPSPPLEPVPKTEPEPPSVKSSSGENKRKRKRVLKSKTYLDGEGCIVTEKVYESESCTDSEEELNMKTSSVHRPPAMTVKKEPREERKGPKKGTAALGKANRQVSITGFFQRK

SEQ ID NO: 335 - protein, 2286 aa, Homo sapiens; identical to SEQ ID NO: 331

SEQ ID NO: 336 - protein, 261 aa, Homo sapiens
MFEARLVQGSILKKVLEALKDLINEACWDISSSGVNLQSMDSSHVSLVQLTLRSEGFDTYRCDRNLAMGVNLTSMSKILKCAGNEDIITLRAEDNADTLALVFEAPNQEKVSDYEMKLMDLDVEQLGIPEQEYSCVVKMPSGEFARICRDLSHIGDAVVISCAKDGVKFSASGELGNGNIKLSQTSNVDKEEEAVTIEMNEPVQLTFALRYLNFFTKATPLSSTVTLSMSADVPLVVEYKIADMGHLKYYLAPKIEDEEGS

SEQ ID NO: 337 - protein, 318 aa, Homo sapiens
MPKRGKKGAVAEDGDELRTEPEAKKSKTAAKKNDKEAAGEGPALYEDPPDQKTSPSGKPATLKICSWNVDGLRAWIKKKGLDWVKEEAPDILCLQETKCSENKLPAELQELPGLSHQYWSAPSDKEGYSGVGLLSRQCPLKVSYGIGDEEHDQEGRVIVAEFDSFVLVTAYVPNAGRGLVRLEYRQRWDEAFRKFLKGLASRKPLVLCGDLNVAHEEIDLRNPKGNKKNAGFTPQERQGFGELLQAVPLADSFRHLYPNTPYAYTFWTYMMNARSKNVGWRLDYFLLSHSLLPALCDSKIRSKALGSDHCPITLYLAL

SEQ ID NO: 338 - protein, 342 aa, Homo sapiens
MMRVCWLVRQDSRHQRIRLPHLEAVVIGRGPETKITDKKCSRQQVQLKAECNKGYVKVKQVGVNPTSIDSVVIGKDQEVKLQPGQVLHMVNELYPYIVEFEEEAKNPGLETHRKRKRSGNSDSIERDAAQEAEAGTGLEPGSNSGQCSVPLKKGKDAPIKKESLGHWSQGLKISMQDPKMQVYKDEQVVVIKDKYPKARYHWLVLPWTSISSLKAVAREHLELLKHMHTVGEKVIVDFAGSSKLRFRLGYHAIPSMSHVHLHVISQDFDSPCLKNKKHWNSFNTEYFLESQAVIEMVQEAGRVTVRDGMPELLKLPLRCHECQQLLPSIPQLKEHLRKHWTQ

SEQ ID NO: 339 - protein, 30 aa, Artificial Sequence
  Synthetic
  misc_feature (4)..(30): "Gly-Gly-Ser" may or may not be present
GGSGGSGGSGGSGGSGGSGGSGGSGGSGGS

SEQ ID NO: 340 - protein, 302 aa, Homo sapiens
MSNVNLSVSDFWRVMMRVCWLVRQDSRHQRIRLPHLEAVVIGRGPETKITDKKCSRQQEFEEEAKNPGLETHRKRKRSGNSDSIERDAAQEAEAGTGLEPGSNSGQCSVPLKKGKDAPIKKESLGHWSQGLKISMQDPKMQVYKDEQVVVIKDKYPKARYHWLVLPWTSISSLKAVAREHLELLKHMHTVGEKVIVDFAGSSKLRFRLGYHAIPSMSHVHLHVISQDFDSPCLKNKKHWNSFNTEYFLESQAVIEMVQEAGRVTVRDGMPELLKLPLRCHECQQLLPSIPQLKEHLRKHWTQ

SEQ ID NO: 341 - protein, 20 aa, Artificial Sequence
  Synthetic
  misc_feature (3)..(20): "Gly-Ser" may or may not be present
GSGSGSGSGSGSGSGSGSGS

SEQ ID NO: 342 - protein, 288 aa, Homo sapiens
MMRVCWLVRQDSRHQRIRLPHLEAVVIGRGPETKITDKKCSRQQEFEEEAKNPGLETHRKRKRSGNSDSIERDAAQEAEAGTGLEPGSNSGQCSVPLKKGKDAPIKKESLGHWSQGLKISMQDPKMQVYKDEQVVVIKDKYPKARYHWLVLPWTSISSLKAVAREHLELLKHMHTVGEKVIVDFAGSSKLRFRLGYHAIPSMSHVHLHVISQDFDSPCLKNKKHWNSFNTEYFLESQAVIEMVQEAGRVTVRDGMPELLKLPLRCHECQQLLPSIPQLKEHLRKHWTQ

SEQ ID NO: 343 - protein, 511 aa, Homo sapiens; identical to SEQ ID NO: 295

SEQ ID NO: 344 - protein, 64 aa, Artificial Sequence
  Synthetic
SGSETPGTSESATPESSGSETPGTSESATPESSGSETPGTSESATPESSGSETPGTSESATPES

SEQ ID NO: 345 - protein, 48 aa, Artificial Sequence; identical to SEQ ID NO: 201
  Synthetic
  misc_feature (13)..(48): "GSAGSAAGSGEF" may or may not be present

SEQ ID NO: 346 - protein, 48 aa, Artificial Sequence; identical to SEQ ID NO: 202
  Synthetic
  misc_feature (13)..(48): "SIVAQLSRPDPA" may or may not be present

SEQ ID NO: 347 - protein, 298 aa, Homo sapiens
MSQEGDYGRWTISSSDESEEEKPKPDKPSTSSLLCARQGAANEPRYTCSEAQKAAHKRKISPVKFSNTDSVLPPKRQKSGSQEDLGWCLSSSDDELQPEMPQKQAEKVVIKKEKDISAPNDGTAQRTENHGAPACHRLKEEEDEYETSGEGQDIWDMLDKGNPFQFYLTRVSGVKPKYNSGALHIKDILSPLFGTLVSSAQFNYCFDVDWLVKQYPPEFRKKPILLVHGDKREAKAHLHAQAKPYENISLCQAKLDIAFGTHHTKMMLLLYEEGLRVVIHTSNLIHADWHQKTQGTHL

SEQ ID NO: 348 - protein, 934 aa, Homo sapiens [sequence omitted]

SEQ ID NO: 349 - protein, 868 aa, Homo sapiens
MGPAGAKNLQSVVLSKMNFESFVKDLLLVRQYRVEVYKNRAGNKASKENDWYLAYKASPGNLSQFEDILFGNNDMSASIGVVGVKMSAVDGQRQVGVGYVDSIQRKLGLCEFPDNDQFSNLEALLIQIGPKECVLPGGETAGDMGKLRQIIQRGGILITERKKADFSTKDIYQDLNRLLKGKKGEQMNSAVLPEMENQVAVSSLSAVIKFLELLSDDSNFGQFELTTFDFSQYMKLDIAAVRALNLFQGSVEDTTGSQSLAALLNKCKTPQGQRLVNQWIKQPLMDKNRIEERLNLVEAFVEDAELRQTLQEDLLRRFPDLNRLAKKFQRQAANLQDCYRLYQGINQLPNVIQALEKHEGKHQKLLLAVFVTPLTDLRSDFSKFQEMIETTLDMDQVENHEFLVKPSFDPNLSELREIMNDLEKKMQSTLISAARDLGLDPGKQIKLDSSAQFGYYFRVTCKEEKVLRNNKNFSTVDIQKNGVKFTNSKLTSLNEEYTKNKTEYEEAQDAIVKEIVNISSGYVEPMQTLNDVLAQLDAVVSFAHVSNGAPVPYVRPAILEKGQGRIILKASRHACVEVQDEIAFIPNDVYFEKDKQMFHIITGPNMGGKSTYIRQTGVIVLMAQIGCFVPCESAEVSIVDCILARVGAGDSQLKGVSTFMAEMLETASILRSATKDSLIIIDELGRGTSTYDGFGLAWAISEYIATKIGAFCMFATHFHELTALANQIPTVNNLHVTALTTEETLTMLYQVKKGVCDQSFGIHVAELANFPKHVIECAKQKALELEEFQYIGESQGYDIMEPAAKKCYLEREQGEKIIQEFLSKVKQMPFTEMSEENITIKLKQLKAEVIAKNNSFVNEIISRIKVTT

SEQ ID NO: 350 - protein, 1137 aa, Homo sapiens
MSRRKPASGGLAASSSAPARQAVLSRFFQSTGSLKSTSSSTGAADQVDPGAAAAAAAAAAAAPPAPPAPAFPPQLPPHIATEIDRRKKRPLENDGPVKKKVKKVQQKEGGSDLGMSGNSEPKKCLRTRNVSKSLEKLKEFCCDSALPQSRVQTESLQERFAVLPKCTDFDDISLLHAKNAVSSEDSKRQINQKDTTLFDLSQFGSSNTSHENLQKTASKSANKRSKSIYTPLELQYIEMKQQHKDAVLCVECGYKYRFFGEDAEIAARELNIYCHLDHNFMTASIPTHRLFVHVRRLVAKGYKVGVVKQTETAALKAIGDNRSSLFSRKLTALYTKSTLIGEDVNPLIKLDDAVNVDEIMTDTSTSYLLCISENKENVRDKKKGNIFIGIVGVQPATGEVVFDSFQDSASRSELETRMSSLQPVELLLPSALSEQTEALIHRATSVSVQDDRIRVERMDNIYFEYSHAFQAVTEFYAKDTVDIKGSQIISGIVNLEKPVICSLAAIIKYLKEFNLEKMLSKPENFKQLSSKMEFMTINGTTLRNLEILQNQTDMKTKGSLLWVLDHTKTSFGRRKLKKWVTQPLLKLREINARLDAVSEVLHSESSVFGQIENHLRKLPDIERGLCSIYHKKCSTQEFFLIVKTLYHLKSEFQAIIPAVNSHIQSDLLRTVILEIPELLSPVEHYLKILNEQAAKVGDKTELFKDLSDFPLIKKRKDEIQGVIDEIRMHLQEIRKILKNPSAQYVTVSGQEFMIEIKNSAVSCIPTDWVKVGSTKAVSRFHSPFIVENYRHLNQLREQLVLDCSAEWLDFLEKFSEHYHSLCKAVHHLATVDCIFSLAKVAKQGDYCRPTVQEERKIVIKNGRHPVIDVLLGEQDQYVPNNTDLSEDSERVMIITGPNMGGKSSYIKQVALITIMAQIGSYVPAEEATIGIVDGIFTRMGAADNIYKGQSTFMEELTDTAEIIRKATSQSLVILDELGRGTSTHDGIAIAYATLEYFIRDVKSLTLFVTHYPPVCELEKNYSHQVGNYHMGFLVSEDESKLDPGAAEQVPDFVTFLYQITRGIAARSYGLNVAKLADVPGEILKKAAHKSKELEGLINTKRKRLKYFAKLWTMHNAQDLQKWTEEFNMEETQTSLLH

SEQ ID NO: 351 - protein, 1360 aa, Homo sapiens
MSRQSTLYSFFPKSPALSDANKASARASREGGRAAAAPGASPSPGGDAAWSEAGPGPRPLARSASPPKAKNLNGGLRRSVAPAAPTSCDFSPGDLVWAKMEGYPWWPCLVYNHPFDGTFIREKGKSVRVHVQFFDDSPTRGWVSKRLLKPYTGSKSKEAQKGGHFYSAKPEILRAMQRADEALNKDKIKRLELAVCDEPSEPEEEEEMEVGTTYVTDKSEEDNEIESEEEVQPKTQGSRRSSRQIKKRRVISDSESDIGGSDVEFKPDTKEEGSSDEISSGVGDSESEGLNSPVKVARKRKRMVTGNGSLKRKSSRKETPSATKQATSISSETKNTLRAFSAPQNSESQAHVSGGGDDSSRPTVWYHETLEWLKEEKRRDEHRRRPDHPDFDASTLYVPEDFLNSCTPGMRKWWQIKSQNFDLVICYKVGKFYELYHMDALIGVSELGLVFMKGNWAHSGFPEIAFGRYSDSLVQKGYKVARVEQTETPEMMEARCRKMAHISKYDRVVRREICRIITKGTQTYSVLEGDPSENYSKYLLSLKEKEEDSSGHTRAYGVCFVDTSLGKFFIGQFSDDRHCSRFRTLVAHYPPVQVLFEKGNLSKETKTILKSSLSCSLQEGLIPGSQFWDASKTLRTLLEEEYFREKLSDGIGVMLPQVLKGMTSESDSIGLTPGEKSELALSALGGCVFYLKKCLIDQELLSMANFEEYIPLDSDTVSTTRSGAIFTKAYQRMVLDAVTLNNLEIFLNGTNGSTEGTLLERVDTCHTPFGKRLLKQWLCAPLCNHYAINDRLDAIEDLMVVPDKISEVVELLKKLPDLERLLSKIHNVGSPLKSQNHPDSRAIMYEETTYSKKKIIDFLSALEGFKVMCKIIGIMEEVADGFKSKILKQVISLQTKNPEGRFPDLTVELNRWDTAFDHEKARKTGLITPKAGFDSDYDQALADIRENEQSLLEYLEKQRNRIGCRTIVYWGIGRNRYQLEIPENFTTRNLPEEYELKSTKKGCKRYWTKTIEKKLANLINAEERRDVSLKDCMRRLFYNFDKNYKDWQSAVECIAVLDVLLCLANYSRGGDGPMCRPVILLPEDTPPFLELKGSRHPCITKTFFGDDFIPNDILIGCEEEEQENGKAYCVLVTGPNMGGKSTLMRQAGLLAVMAQMGCYVPAEVCRLTPIDRVFTRLGASDRIMSGESTFFVELSETASILMHATAHSLVLVDELGRGTATFDGTAIANAVVKELAETIKCRTLFSTHYHSLVEDYSQNVAVRLGHMACMVENECEDPSQETITFLYKFIKGACPKSYGFNAARLANLPEEVIQKGHRKAREFEKMNQSLRLFREVCLASERSTVDAEAVHKLLTLIKEL

SEQ ID NO: 352 - protein, 756 aa, Homo sapiens
MSFVAGVIRRLDETVVNRIAAGEVIQRPANAIKEMIENCLDAKSTSIQVIVKEGGLKLIQIQDNGTGIRKEDLDIVCERFTTSKLQSFEDLASISTYGFRGEALASISHVAHVTITTKTADGKCAYRASYSDGKLKAPPKPCAGNQGTQITVEDLFYNIATRRKALKNPSEEYGKILEVVGRYSVHNAGISFSVKKQGETVADVRTLPNASTVDNIRSIFGNAVSRELIEIGCEDKTLAFKMNGYISNANYSVKKCIFLLFINHRLVESTSLRKAIETVYAAYLPKNTHPFLYLSLEISPQNVDVNVHPTKHEVHFLHEESILERVQQHIESKLLGSNSSRMYFTQTLLPGLAGPSGEMVKSTTSLTSSSTSGSSDKVYAHQMVRTDSREQKLDAFLQPLSKPLSSQPQAIVTEDKTDISSGRARQQDEEMLELPAPAEVAAKNQSLEGDTTKGTSEMSEKRGPTSSNPRKRHREDSDVEMVEDDSRKEMTAACTPRRRIINLTSVLSLQEEINEQGHEVLREMLHNHSFVGCVNPQWALAQHQTKLYLLNTTKLSEELFYQILIYDFANFGVLRLSEPAPLFDLAMLALDSPESGWTEEDGPKEGLAEYIVEFLKKKAEMLADYFSLEIDEEGNLIGLPLLIDNYVPPLEGLPIFILRLATEVNWDEEKECFESLSKECAMFYSIRKQYISEESTLSGQQSEVPGSIPNSWKWTVEHIVYKALRSHILPPKHFTEDGNILQLANLPDLYKVFERC

SEQ ID NO: 353 - protein, 515 aa, Homo sapiens
MNGYISNANYSVKKCIFLLFINHRLVESTSLRKAIETVYAAYLPKNTHPFLYLSLEISPQNVDVNVHPTKHEVHFLHEESILERVQQHIESKLLGSNSSRMYFTQTLLPGLAGPSGEMVKSTTSLTSSSTSGSSDKVYAHQMVRTDSREQKLDAFLQPLSKPLSSQPQAIVTEDKTDISSGRARQQDEEMLELPAPAEVAAKNQSLEGDTTKGTSEMSEKRGPTSSNPRKRHREDSDVEMVEDDSRKEMTAACTPRRRIINLTSVLSLQEEINEQGHEVLREMLHNHSFVGCVNPQWALAQHQTKLYLLNTTKLSEELFYQILIYDFANFGVLRLSEPAPLFDLAMLALDSPESGWTEEDGPKEGLAEYIVEFLKKKAEMLADYFSLEIDEEGNLIGLPLLIDNYVPPLEGLPIFILRLATEVNWDEEKECFESLSKECAMFYSIRKQYISEESTLSGQQSEVPGSIPNSWKWTVEHIVYKALRSHILPPKHFTEDGNILQLANLPDLYKVFERC

SEQ ID NO: 354 - protein, 658 aa, Homo sapiens
MAFEALASISHVAHVTITTKTADGKCAYRASYSDGKLKAPPKPCAGNQGTQITVEDLFYNIATRRKALKNPSEEYGKILEVVGRYSVHNAGISFSVKKQGETVADVRTLPNASTVDNIRSIFGNAVSRELIEIGCEDKTLAFKMNGYISNANYSVKKCIFLLFINHRLVESTSLRKAIETVYAAYLPKNTHPFLYLSLEISPQNVDVNVHPTKHEVHFLHEESILERVQQHIESKLLGSNSSRMYFTQTLLPGLAGPSGEMVKSTTSLTSSSTSGSSDKVYAHQMVRTDSREQKLDAFLQPLSKPLSSQPQAIVTEDKTDISSGRARQQDEEMLELPAPAEVAAKNQSLEGDTTKGTSEMSEKRGPTSSNPRKRHREDSDVEMVEDDSRKEMTAACTPRRRIINLTSVLSLQEEINEQGHEVLREMLHNHSFVGCVNPQWALAQHQTKLYLLNTTKLSEELFYQILIYDFANFGVLRLSEPAPLFDLAMLALDSPESGWTEEDGPKEGLAEYIVEFLKKKAEMLADYFSLEIDEEGNLIGLPLLIDNYVPPLEGLPIFILRLATEVNWDEEKECFESLSKECAMFYSIRKQYISEESTLSGQQSEVPGSIPNSWKWTVEHIVYKALRSHILPPKHFTEDGNILQLANLPDLYKVFERC

SEQ ID NO: 355 - protein, 862 aa, Homo sapiens
MERAESSSTEPAKAIKPIDRKSVHQICSGQVVLSLSTAVKELVENSLDAGATNIDLKLKDYGVDLIEVSDNGCGVEEENFEGLTLKHHTSKIQEFADLTQVETFGFRGEALSSLCALSDVTISTCHASAKVGTRLMFDHNGKIIQKTPYPRPRGTTVSVQQLFSTLPVRHKEFQRNIKKEYAKMVQVLHAYCIISAGIRVSCTNQLGQGKRQPVVCTGGSPSIKENIGSVFGQKQLQSLIPFVQLPPSDSVCEEYGLSCSDALHNLFYISGFISQCTHGVGRSSTDRQFFFINRRPCDPAKVCRLVNEVYHMYNRHQYPFVVLNISVDSECVDINVTPDKRQILLQEEKLLLAVLKTSLIGMFDSDVNKLNVSQQPLLDVEGNLIKMHAADLEKPMVEKQDQSPSLRTGEEKKDVSISRLREAFSLRHTTENKPHSPKTPEPRRSPLGQKRGMLSSSTSGAISDKGVLRPQKEAVSSSHGPSDPTDRAEVEKDSGHGSTSVDSEGFSIPDTGSHCSSEYAASSPGDRGSQEHVDSQEKAPKTDDSFSDVDCHSNQEDTGCKFRVLPQPTNLATPNTKRFKKEEILSSSDICQKLVNTQDMSASQVDVAVKINKKVVPLDFSMSSLAKRIKQLHHEAQQSEGEQNYRKFRAKICPGENQAAEDELRKEISKTMFAEMEIIGQFNLGFIITKLNEDIFIVDQHATDEKYNFEMLQQHTVLQGQRLIAPQTLNLTAVNEAVLIENLEIFRKNGFDFVIDENAPVTERAKLISLPTSKNWTFGPQDVDELIFMLSDSPGVMCRPSRVKQMFASRACRKSVMIGTALNTSEMKKLITHMGEMDHPWNCPHGRPTMRHIANLGVISQN

SEQ ID NO: 356 - protein, 461 aa, Homo sapiens
MERAESSSTEPAKAIKPIDRKSVHQICSGQVVLSLSTAVKELVENSLDAGATNIDLKLKDYGVDLIEVSDNGCGVEEENFEGLTLKHHTSKIQEFADLTQVETFGFRGEALSSLCALSDVTISTCHASAKVGTRLMFDHNGKIIQKTPYPRPRGTTVSVQQLFSTLPVRHKEFQRNIKKEYAKMVQVLHAYCIISAGIRVSCTNQLGQGKRQPVVCTGGSPSIKENIGSVFGQKQLQSLIPFVQLPPSDSVCEEYGLSCSDALHNLFYKTMFAEMEIIGQFNLGFIITKLNEDIFIVDQHATDEKYNFEMLQQHTVLQGQRLIAPQTLNLTAVNEAVLIENLEIFRKNGFDFVIDENAPVTERAKLISLPTSKNWTFGPQDVDELIFMLSDSPGVMCRPSRVKQMFASRACRKSVMIGTALNTSEMKKLITHMGEMDHPWNCPHGRPTMRHIANLGVISQN

SEQ ID NO: 357 - protein, 572 aa, Homo sapiens
MERAESSSTEPAKAIKPIDRKSVHQICSGQVVLSLSTAVKELVENSLDAGATNIDLKLKDYGVDLIEVSDNGCGVEEENFEGLTLKHHTSKIQEFADLTQVETFGFRGEALSSLCALSDVTISTCHASAKVGTRLMFDHNGKIIQKTPYPRPRGTTVSVQQLFSTLPVRHKEFQRNIKKEYAKMVQVLHAYCIISAGIRVSCTNQLGQGKRQPVVCTGGSPSIKENIGSVFGQKQLQSLIPFVQLPPSDSVCEEYGLSCSDALHNLFYISGFISQCTHGVGRSSTDRQFFFINRRPCDPAKVCRLVNEVYHMYNRHQYPFVVLNISVDSECVDINVTPDKRQILLQEEKLLLAVLKTSLIGMFDSDVNKLNVSQQPLLDVEGNLIKMHAADLEKPMVEKQDQSPSLRTGEEKKDVSISRLREAFSLRHTTENKPHSPKTPEPRRSPLGQKRGMLSSSTSGAISDKGVLRPQKEAVSSSHGPSDPTDRAEVEKDSGHGSTSVDSEGFSIPDTGSHCSSEYAASSPGDRGSQEHVDSQEKAPKTDDSFSDVDCHSNQEDTGLKTGPSDPRTSMN

SEQ ID NO: 358 - protein, 183 aa, Homo sapiens
MERAESSSTEPAKAIKPIDRKSVHQICSGQVVLSLSTAVKELVENSLDAGATNIDLKLKDYGVDLIEVSDNGCGVEEENFEGLTLKHHTSKIQEFADLTQVETFGFRGEALSSLCALSDVTISTCHASAKVGTRLMFDHNGKIIQKTPYPRPRGTTVSVQQLFSTLPVRHKEFQRNIKKQASV

SEQ ID NO: 359 - protein, 1453 aa, Homo sapiens
MIKCLSVEVQAKLRSGLAISSLGQCVEELALNSIDAEAKCVAVRVNMETFQVQVIDNGFGMGSDDVEKVGNRYFTSKCHSVQDLENPRFYGFRGEALANIADMASAVEISSKKNRTMKTFVKLFQSGKALKACEADVTRASAGTTVTVYNLFYQLPVRRKCMDPRLEFEKVRQRIEALSLMHPSISFSLRNDVSGSMVLQLPKTKDVCSRFCQIYGLGKSQKLREISFKYKEFELSGYISSEAHYNKNMQFLFVNKRLVLRTKLHKLIDFLLRKESIICKPKNGPTSRQMNSSLRHRSTPELYGIYVINVQCQFCEYDVCMEPAKTLIEFQNWDTLLFCIQEGVKMFLKQEKLFVELSGEDIKEFSEDNGFSLFDATLQKRVTSDERSNFQEACNNILDSYEMFNLQSKAVKRKTTAENVNTQSSRDSEATRKNTNDAFLYIYESGGPGHSKMTEPSLQNKDSSCSESKMLEQETIVASEAGENEKHKKSFLEHSSLENPCGTSLEMFLSPFQTPCHFEESGQDLEIWKESTTVNGMAANILKNNRIQNQPKRFKDATEVGCQPLPFATTLWGVHSAQTEKEKKKESSNCGRRNVFSYGRVKLCSTGFITHVVQNEKTKSTETEHSFKNYVRPGPTRAQETFGNRTRHSVETPDIKDLASTLSKESGQLPNKKNCRTNISYGLENEPTATYTMFSAFQEGSKKSQTDCILSDTSPSFPWYRHVSNDSRKTDKLIGFSKPIVRKKLSLSSQLGSLEKFKRQYGKVENPLDTEVEESNGVTTNLSLQVEPDILLKDKNRLENSDVCKITTMEHSDSDSSCQPASHILNSEKFPFSKDEDCLEQQMPSLRESPMTLKELSLFNRKPLDLEKSSESLASKLSRLKGSERETQTMGMMSRFNELPNSDSSRKDSKLCSVLTQDFCMLFNNKHEKTENGVIPTSDSATQDNSFNKNSKTHSNSNTTENCVISETPLVLPYNNSKVTGKDSDVLIRASEQQIGSLDSPSGMLMNPVEDATGDQNGICFQSEESKARACSETEESNTCCSDWQRHFDVALGRMVYVNKMTGLSTFIAPTEDIQAACTKDLTTVAVDVVLENGSQYRCQPFRSDLVLPFLPRARAERTVMRQDNRDTVDDTVSSESLQSLFSEWDNPVFARYPEVAVDVSSGQAESLAVKIHNILYPYRFTKGMIHSMQVLQQVDNKFIACLMSTKTEENGEAGGNLLVLVDQHAAHERIRLEQLIIDSYEKQQAQGSGRKKLLSSTLIPPLEITVTEEQRRLLWCYHKNLEDLGLEFVFPDTSDSLVLVGKVPLCFVEREANELRRGRSTVTKSIVEEFIREQLELLQTTGGIQGTLPLTVQKVLASQACHGAIKFNDGLSLQESCRLIEALSSCQLPFQCAHGRPSMLPLADIDHLEQEKQIKPNLTKLRKMAQAWRLFGKAECDTRQSLQQSMPPCEPP

SEQ ID NO: 360 - protein, 1429 aa, Homo sapiens
MIKCLSVEVQAKLRSGLAISSLGQCVEELALNSIDAEAKCVAVRVNMETFQVQVIDNGFGMGSDDVEKVGNRYFTSKCHSVQDLENPRFYGFRGEALANIADMASAVEISSKKNRTMKTFVKLFQSGKALKACEADVTRASAGTTVTVYNLFYQLPVRRKCMDPRLEFEKVRQRIEALSLMHPSISFSLRNDVSGSMVLQLPKTKDVCSRFCQIYGLGKSQKLREISFKYKEFELSGYISSEAHYNKNMQFLFVNKRLVLRTKLHKLIDFLLRKESIICKPKNGPTSRQMNSSLRHRSTPELYGIYVINVQCQFCEYDVCMEPAKTLIEFQNWDTLLFCIQEGVKMFLKQEKLFVELSGEDIKEFSEDNGFSLFDATLQKRVTSDERSNFQEACNNILDSYEMFNLQSKAVKRKTTAENVNTQSSRDSEATRKNTNDAFLYIYESGGPGHSKMTEPSLQNKDSSCSESKMLEQETIVASEAGENEKHKKSFLEHSSLENPCGTSLEMFLSPFQTPCHFEESGQDLEIWKESTTVNGMAANILKNNRIQNQPKRFKDATEVGCQPLPFATTLWGVHSAQTEKEKKKESSNCGRRNVFSYGRVKLCSTGFITHVVQNEKTKSTETEHSFKNYVRPGPTRAQETFGNRTRHSVETPDIKDLASTLSKESGQLPNKKNCRTNISYGLENEPTATYTMFSAFQEGSKKSQTDCILSDTSPSFPWYRHVSNDSRKTDKLIGFSKPIVRKKLSLSSQLGSLEKFKRQYGKVENPLDTEVEESNGVTTNLSLQVEPDILLKDKNRLENSDVCKITTMEHSDSDSSCQPASHILNSEKFPFSKDEDCLEQQMPSLRESPMTLKELSLFNRKPLDLEKSSESLASKLSRLKGSERETQTMGMMSRFNELPNSDSSRKDSKLCSVLTQDFCMLFNNKHEKTENGVIPTSDSATQDNSFNKNSKTHSNSNTTENCVISETPLVLPYNNSKVTGKDSDVLIRASEQQIGSLDSPSGMLMNPVEDATGDQNGICFQSEESKARACSETEESNTCCSDWQRHFDVALGRMVYVNKMTGLSTFIAPTEDIQAACTKDLTTVAVDVVLENGSQYRCQPFRSDLVLPFLPRARAERTVMRQDNRDTVDDTVSSESLQSLFSEWDNPVFARYPEVAVDVSSGQAESLAVKIHNILYPYRFTKGMIHSMQVLQQVDNKFIACLMSTKTEENGEADSYEKQQAQGSGRKKLLSSTLIPPLEITVTEEQRRLLWCYHKNLEDLGLEFVFPDTSDSLVLVGKVPLCFVEREANELRRGRSTVTKSIVEEFIREQLELLQTTGGIQGTLPLTVQKVLASQACHGAIKFNDGLSLQESCRLIEALSSCQLPFQCAHGRPSMLPLADIDHLEQEKQIKPNLTKLRKMAQAWRLFGKAECDTRQSLQQSMPPCEPP

SEQ ID NO: 361 - protein, 215 aa, Homo sapiens
MGKGDPKKPRGKMSSYAFFVQTCREEHKKKHPDASVNFSEFSKKCSERWKTMSAKEKGKFEDMAKADKARYEREMKTYIPPKGETKKKFKDPNAPKRPPSAFFLFCSEYRPKIKGEHPGLSIGDVAKKLGEMWNNTAADDKQPYEKKAAKLKEKYEKDIAAYRAKGKPDAAKKGVVKAEKSKKKKEEEEDEEDEEDEEEEEDEEDEDEEEDDDDE

SEQ ID NO: 362 - protein, 158 aa, Homo sapiens
MGKGDPKKPRGKMSSYAFFVQTCREEHKKKHPDASVNFSEFSKKCSERWKTMSAKEKGKFEDMAKADKARYEREMKTYIPPKGETKKKFKDPNAPKRPPSAFFLFCSEYRPKIKGEHPGLSIGDVAKKLGEMWNNTAADDKQPYEKKAAKLKEKYEKF

SEQ ID NO: 363 - protein, 1148 aa, Homo sapiens
MDIRKFFGVIPSGKKLVSETVKKNEKTKSDEETLKAKKGIKEIKVNSSRKEDDFKQKQPSKKKRIIYDSDSESEETLQVKNAKKPPEKLPVSSKPGKISRQDPVTYISETDEEDDFMCKKAASKSKENGRSTNSHLGTSNMKKNEENTKTKNKPLSPIKLTPTSVLDYFGTGSVQRSNKKMVASKRKELSQNTDESGLNDEAIAKQLQLDEDAELERQLHEDEEFARTLAMLDEEPKTKKARKDTEAGETFSSVQANLSKAEKHKYPHKVKTAQVSDERKSYSPRKQSKYESSKESQQHSKSSADKIGEVSSPKASSKLAIMKRKEESSYKEIEPVASKRKENAIKLKGETKTPKKTKSSPAKKESVSPEDSEKKRTNYQAYRSYLNREGPKALGSKEIPKGAENCLEGLIFVITGVLESIERDEAKSLIERYGGKVTGNVSKKTNYLVMGRDSGQSKSDKAAALGTKIIDEDGLLNLIRTMPGKKSKYEIAVETEMKKESKLERTPQKNVQGKRKISPSKKESESKKSRPTSKRDSLAKTIKKETDVFWKSLDFKEQVAEETSGDSKARNLADDSSENKVENLLWVDKYKPTSLKTIIGQQGDQSCANKLLRWLRNWQKSSSEDKKHAAKFGKFSGKDDGSSFKAALLSGPPGVGKTTTASLVCQELGYSYVELNASDTRSKSSLKAIVAESLNNTSIKGFYSNGAASSVSTKHALIMDEVDGMAGNEDRGGIQELIGLIKHTKIPIICMCNDRNHPKIRSLVHYCFDLRFQRPRVEQIKGAMMSIAFKEGLKIPPPAMNEIILGANQDIRQVLHNLSMWCARSKALTYDQAKADSHRAKKDIKMGPFDVARKVFAAGEETAHMSLVDKSDLFFHDYSIAPLFVQENYIHVKPVAAGGDMKKHLMLLSRAADSICDGDLVDSQIRSKQNWSLLPAQAIYASVLPGELMRGYMTQFPTFPSWLGKHSSTGKHDRIVQDLALHMSLRTYSSKRTVNMDYLSLLRDALVQPLTSQGVDGVQDVVALMDTYYLMKEDFENIMEISSWGGKPSPFSKLDPKVKAAFTRAYNKEAHLTPYSLQAIKASRHSTSPSLDSEYNEELNEDDSQSDEKDQDAIETDAMIKKKTKSSKPSKPEKDKEPRKGKGKSSKK

SEQ ID NO: 364 - protein, 1147 aa, Homo sapiens
MDIRKFFGVIPSGKKLVSETVKKNEKTKSDEETLKAKKGIKEIKVNSSRKEDDFKQKQPSKKKRIIYDSDSESEETLQVKNAKKPPEKLPVSSKPGKISRQDPVTYISETDEEDDFMCKKAASKSKENGRSTNSHLGTSNMKKNEENTKTKNKPLSPIKLTPTSVLDYFGTGSVQRSNKKMVASKRKELSQNTDESGLNDEAIAKQLQLDEDAELERQLHEDEEFARTLAMLDEEPKTKKARKDTEAGETFSSVQANLSKAEKHKYPHKVKTAQVSDERKSYSPRKQSKYESSKESQQHSKSSADKIGEVSSPKASSKLAIMKRKEESSYKEIEPVASKRKENAIKLKGETKTPKKTKSSPAKKESVSPEDSEKKRTNYQAYRSYLNREGPKALGSKEIPKGAENCLEGLIFVITGVLESIERDEAKSLIERYGGKVTGNVSKKTNYLVMGRDSGQSKSDKAAALGTKIIDEDGLLNLIRTMPGKKSKYEIAVETEMKKESKLERTPQKNVQGKRKISPSKKESESKKSRPTSKRDSLAKTIKKETDVFWKSLDFKEQVAEETSGDSKARNLADDSSENKVENLLWVDKYKPTSLKTIIGQQGDQSCANKLLRWLRNWQKSSSEDKKHAKFGKFSGKDDGSSFKAALLSGPPGVGKTTTASLVCQELGYSYVELNASDTRSKSSLKAIVAESLNNTSIKGFYSNGAASSVSTKHALIMDEVDGMAGNEDRGGIQELIGLIKHTKIPIICMCNDRNHPKIRSLVHYCFDLRFQRPRVEQIKGAMMSIAFKEGLKIPPPAMNEIILGANQDIRQVLHNLSMWCARSKALTYDQAKADSHRAKKDIKMGPFDVARKVFAAGEETAHMSLVDKSDLFFHDYSIAPLFVQENYIHVKPVAAGGDMKKHLMLLSRAADSICDGDLVDSQIRSKQNWSLLPAQAIYASVLPGELMRGYMTQFPTFPSWLGKHSSTGKHDRIVQDLALHMSLRTYSSKRTVNMDYLSLLRDALVQPLTSQGVDGVQDVVALMDTYYLMKEDFENIMEISSWGGKPSPFSKLDPKVKAAFTRAYNKEAHLTPYSLQAIKASRHSTSPSLDSEYNEELNEDDSQSDEKDQDAIETDAMIKKKTKSSKPSKPEKDKEPRKGKGKSSKK

SEQ ID NO: 365 - protein, 1208 aa, Homo sapiens; identical to SEQ ID NO: 178

SEQ ID NO: 366 - protein, 535 aa, Homo sapiens
MTPLVSRLSRLWAIMRKPRAAVGSGHRKQAASQEGRQKHAKNNSQAKPSACDGLARQPEEVVLQASVSSYHLFRDVAEVTAFRGSLLSWYDQEKRDLPWRRRAEDEMDLDRRAYAVWVSEVMLQQTQVATVINYYTGWMQKWPTLQDLASASLEEVNQLWAGLGYYSRGRRLQEGARKVVEELGGHMPRTAETLQQLLPGVGRYTAGAIASIAFGQATGVVDGNVARVLCRVRAIGADPSSTLVSQQLWGLAQQLVDPARPGDFNQAAMELGATVCTPQRPLCSQCPVESLCRARQRVEQEQLLASGSLSGSPDVEECAPNTGQCHLCLPPSEPWDQTLGVVNFPRKASRKPPREESSATCVLEQPGALGAQILLVQRPNSGLLAGLWEFPSVTWEPSEQLQRKALLQELQRWAGPLPATHLRHLGEVVHTFSHIKLTYQVYGLALEGQTPVTTVPPGARWLTQEEFHTAAVSTAMKKVFRVYQGQQPGTCMGSKRSQVSSPCSRKKPRMGQQVLDNFFRSHISTDAHSLNSAAQ

SEQ ID NO: 367 - protein, 522 aa, Homo sapiens
MRKPRAAVGSGHRKQAASQEGRQKHAKNNSQAKPSACDAGLARQPEEVVLQASVSSYHLFRDVAEVTAFRGSLLSWYDQEKRDLPWRRRAEDEMDLDRRAYAVWVSEVMLQQTQVATVINYYTGWMQKWPTLQDLASASLEEVNQLWAGLGYYSRGRRLQEGARKVVEELGGHMPRTAETLQQLLPGVGRYTAGAIASIAFGQATGVVDGNVARVLCRVRAIGADPSSTLVSQQLWGLAQQLVDPARPGDFNQAAMELGATVCTPQRPLCSQCPVESLCRARQRVEQEQLLASGSLSGSPDVEECAPNTGQCHLCLPPSEPWDQTLGVVNFPRKASRKPPREESSATCVLEQPGALGAQILLVQRPNSGLLAGLWEFPSVTWEPSEQLQRKALLQELQRWAGPLPATHLRHLGEVVHTFSHIKLTYQVYGLALEGQTPVTTVPPGARWLTQEEFHTAAVSTAMKKVFRVYQGQQPGTCMGSKRSQVSSPCSRKKPRMGQQVLDNFFRSHISTDAHSLNSAAQ

SEQ ID NO: 368 - protein, 521 aa, Homo sapiens
MRKPRAAVGSGHRKQAASQEGRQKHAKNNSQAKPSACDGLARQPEEVVLQASVSSYHLFRDVAEVTAFRGSLLSWYDQEKRDLPWRRRAEDEMDLDRRAYAVWVSEVMLQQTQVATVINYYTGWMQKWPTLQDLASASLEEVNQLWAGLGYYSRGRRLQEGARKVVEELGGHMPRTAETLQQLLPGVGRYTAGAIASIAFGQATGVVDGNVARVLCRVRAIGADPSSTLVSQQLWGLAQQLVDPARPGDFNQAAMELGATVCTPQRPLCSQCPVESLCRARQRVEQEQLLASGSLSGSPDVEECAPNTGQCHLCLPPSEPWDQTLGVVNFPRKASRKPPREESSATCVLEQPGALGAQILLVQRPNSGLLAGLWEFPSVTWEPSEQLQRKALLQELQRWAGPLPATHLRHLGEVVHTFSHIKLTYQVYGLALEGQTPVTTVPPGARWLTQEEFHTAAVSTAMKKVFRVYQGQQPGTCMGSKRSQVSSPCSRKKPRMGQQVLDNFFRSHISTDAHSLNSAAQ

SEQ ID NO: 369 - protein, 536 aa, Homo sapiens
MTPLVSRLSRLWAIMRKPRAAVGSGHRKQAASQEGRQKHAKNNSQAKPSACDAGLARQPEEVVLQASVSSYHLFRDVAEVTAFRGSLLSWYDQEKRDLPWRRRAEDEMDLDRRAYAVWVSEVMLQQTQVATVINYYTGWMQKWPTLQDLASASLEEVNQLWAGLGYYSRGRRLQEGARKVVEELGGHMPRTAETLQQLLPGVGRYTAGAIASIAFGQATGVVDGNVARVLCRVRAIGADPSSTLVSQQLWGLAQQLVDPARPGDFNQAAMELGATVCTPQRPLCSQCPVESLCRARQRVEQEQLLASGSLSGSPDVEECAPNTGQCHLCLPPSEPWDQTLGVVNFPRKASRKPPREESSATCVLEQPGALGAQILLVQRPNSGLLAGLWEFPSVTWEPSEQLQRKALLQELQRWAGPLPATHLRHLGEVVHTFSHIKLTYQVYGLALEGQTPVTTVPPGARWLTQEEFHTAAVSTAMKKVFRVYQGQQPGTCMGSKRSQVSSPCSRKKPRMGQQVLDNFFRSHISTDAHSLNSAAQ

SEQ ID NO: 370 - protein, 713 aa, Homo sapiens
MATGQDRVVALVDMDCFFVQVEQRQNPHLRNKPCAVVQYKSWKGGGIIAVSYEARAFGVTRSMWADDAKKLCPDLLLAQVRESRGKANLTKYREASVEVMEIMSRFAVIERASIDEAYVDLTSAVQERLQKLQGQPISADLLPSTYIEGLPQGPTTAEETVQKEGMRKQGLFQWLDSLQIDNLTSPDLQLTVGAVIVEEMRAAIERETGFQCSAGISHNKVLAKLACGLNKPNRQTLVSHGSVPQLFSQMPIRKIRSLGGKLGASVIEILGIEYMGELTQFTESQLQSHFGEKNGSWLYAMCRGIEHDPVKPRQLPKTIGCSKNFPGKTALATREQVQWWLLQLAQELEERLTKDRNDNDRVATQLVVSIRVQGDKRLSSLRRCCALTRYDAHKMSHDAFTVIKNCNTSGIQTEWSPPLTMLFLCATKFSASAPSSSTDITSFLSSDPSSLPKVPVTSSEAKTQGSGPAVTATKKATTSLESFFQKAAERQKVKEASLSSLTAPTQAPMSNSPSKPSLPFQTSQSTGTEPFFKQKSLLLKQKQLNNSSVSSPQQNPWSNCKALPNSLPTEYPGCVPVCEGVSKLEESSKATPAEMDLAHNSQSMHASSASKSVLEVTQKATPNPSLLAAEDQVPCEKCGSLVPVWDMPEHMDYHFALELQKSFLQPHSSNPQVVSAVSHQGKRNPKSPLACTNKRPRPEGMQTLESFFKPLTH

SEQ ID NO: 371 - protein, 414 aa, Homo sapiens
MATGQDRVVALVDMDCFFVQVEQRQNPHLRNKPCAVVQYKSWKGGGIIAVSYEARAFGVTRSMWADDAKKLCPDLLLAQVRESRGKANLTKYREASVEVMEIMSRFAVIERASIDEAYVDLTSAVQERLQKLQGQPISADLLPSTYIEGLPQGPTTAEETVQKEGMRKQGLFQWLDSLQIDNLTSPDLQLTVGAVIVEEMRAAIERETGFQCSAGISHNKVLAKLACGLNKPNRQTLVSHGSVPQLFSQMPIRKIRSLGGKLGASVIEILGIEYMGELTQFTESQLQSHFGEKNGSWLYAMCRGIEHDPVKPRQLPKTIGCSKNFPGKTALATREQVQWWLLQLAQELEERLTKDRNDNDRVATQLVVSIRVQGDKRLSSLRRCCALTRYDAHKMSHDAFTVIKNCNTSGIQTE

SEQ ID NO: 372 - protein, 396 aa, Homo sapiens
MLGFLSARQTGLEDPLRLRRAESTRRVLGLELNKDRDVERIHGGGINTLDIEPVEGRYMLSGGSDGVIVLYDLENSSRQSYYTCKAVCSIGRDHPDVHRYSVETVQWYPHDTGMFTSSSFDKTLKVWDTNTLQTADVFNFEETVYSHHMSPVSTKHCLVAVGTRGPKVQLCDLKSGSCSHILQGHRQEILAVSWSPRYDYILATASADSRVKLWDVRRASGCLITLDQHNGKKSQAVESANTAHNGKVNGLCFTSDGLHLLTVGTDNRMRLWNSSNGENTLVNYGKVCNNSKKGLKFTVSCGCSSEFVFVPYGSTIAVYTVYSGEQITMLKGHYKTVDCCVFQSNFQELYSGSRDCNILAWVPSLYEPVPDDDETTTKSQLNPAFEDAWSSSDEEG

SEQ ID NO: 373 - protein, 205 aa, Homo sapiens
MLGFLSARQTGLEDPLRLRRAESTRRVLGLELNKDRDVERIHGGGINTLDIEPVEGRYMLSGGSDGVIVLYDLENSSRQSYYTCKAVCSIGRDHPDVHRYSVETVQWYPHDTGMFTSSSFDKTLKVWDTNTLQTADVFNFEETVYSHHMSPVSTKHCLVAVGTRGPKVQLCDLKSGSCSHILQGIFILFQTATTLSKRFNKKKRY

SEQ ID NO: 374 - protein, 1493 aa, Homo sapiens
MPNEGIPHSSQTQEQDCLQSQPVSNNEEMAIKQESGGDGEVEEYLSFRSVGDGLSTSAVGCASAAPRRGPALLHIDRHQIQAVEPSAQALELQGLGVDVYDQDVLEQGVLQQVDNAIHEASRASQLVDVEKEYRSVLDDLTSCTTSLRQINKIIEQLSPQAATSRDINRKLDSVKRQKYNKEQQLKKITAKQKHLQAILGGAEVKIELDHASLEEDAEPGPSSLGSMLMPVQETAWEELIRTGQMTPFGTQIPQKQEKKPRKIMLNEASGFEKYLADQAKLSFERKKQGCNKRAARKAPAPVTPPAPVQNKNKPNKKARVLSKKEERLKKHIKKLQKRALQFQGKVGLPKARRPWESDMRPEAEGDSEGEESEYFPTEEEEEEEDDEVEGAEADLSGDGTDYELKPLPKGGKRQKKVPVQEIDDDFFPSSGEEAEAASVGEGGGGGRKVGRYRDDGDEDYYKQRLRRWNKLRLQDKEKRLKLEDDSEESDAEFDEGFKVPGFLFKKLFKYQQTGVRWLWELHCQQAGGILGDEMGLGKTIQIIAFLAGLSYSKIRTRGSNYRFEGLGPTVIVCPTTVMHQWVKEFHTWWPPFRVAILHETGSYTHKKEKLIRDVAHCHGILITSYSYIRLMQDDISRYDWHYVILDEGHKIRNPNAAVTLACKQFRTPHRIILSGSPMQNNLRELWSLFDFIFPGKLGTLPVFMEQFSVPITMGGYSNASPVQVKTAYKCACVLRDTINPYLLRRMKSDVKMSLSLPDKNEQVLFCRLTDEQHKVYQNFVDSKEVYRILNGEMQIFSGLIALRKICNHPDLFSGGPKNLKGLPDDELEEDQFGYWKRSGKMIVVESLLKIWHKQGQRVLLFSQSRQMLDILEVFLRAQKYTYLKMDGTTTIASRQPLITRYNEDTSIFVFLLTTRVGGLGVNLTGANRVVIYDPDWNPSTDTQARERAWRIGQKKQVTVYRLLTAGTIEEKIYHRQIFKQFLTNRVLKDPKQRRFFKSNDLYELFTLTSPDASQSTETSAIFAGTGSDVQTPKCHLKRRIQPAFGADHDVPKRKKFPASNISVNDATSSEEKSEAKGAEVNAVTSNRSDPLKDDPHMSSNVTSNDRLGEETNAVSGPEELSVISGNGECSNSSGTGKTSMPSGDESIDEKLGLSYKRERPSQAQTEAFWENKQMENNFYKHKSKTKHHSVAEEETLEKHLRPKQKPKNSKHCRDAKFEGTRIPHLVKKRRYQKQDSENKSEAKEQSNDDYVLEKLFKKSVGVHSVMKHDAIMDGASPDYVLVEAEANRVAQDALKALRLSRQRCLGAVSGVPTWTGHRGISGAPAGKKSRFGKKRNSNFSVQHPSSTSPTEKCQDGIMKKEGKDNVPEHFSGRAEDADSSSGPLASSSLLAKMRARNHLILPERLESESGHLQEASALLPTTEHDDLLVEMRNFIAFQAHTDGQASTREILQEFESKLSASQSCVFRELLRNLCTFHRTSGGEGIWKLKPEYC

SEQ ID NO: 375 - protein, 273 aa, Homo sapiens
MAAADGALPEAAALEQPAELPASVRASIERKRQRALMLRQARLAARPYSATAAAATGGMANVKAAPKIIDTGGGFILEEEEEEEQKIGKVVHQPGPVMEFDYVICEECGKEFMDSYLMNHFDLPTCDNCRDADDKHKLITKTEAKQEYLLKDCDLEKREPPLKFIVKKNPHHSQWGDMKLYLKLQIVKRSLEVWGSQEALEEAKEVRQENREKMKQKKFDKKVKELRRAVRSSVWKRETIVHQHEYGPEENLEDDMYRKTCTMCGHELTYEKM

SEQ ID NO: 376 - protein, 782 aa, Homo sapiens
MGKRDRADRDKKKSRKRHYEDEEDDEEDAPGNDPQEAVPSAAGKQVDESGTKVDEYGAKDYRLQMPLKDDHTSRPLWVAPDGHIFLEAFSPVYKYAQDFLVAIAEPVCRPTHVHEYKLTAYSLYAAVSVGLQTSDITEYLRKLSKTGVPDGIMQFIKLCTVSYGKVKLVLKHNRYFVESCHPDVIQHLLQDPVIRECRLRNSEGEATELITETFTSKSAISKTAESSGGPSTSRVTDPQGKSDIPMDLFDFYEQMDKDEEEEEETQTVSFEVKQEMIEELQKRCIHLEYPLLAEYDFRNDSVNPDINIDLKPTAVLRPYQEKSLRKMFGNGRARSGVIVLPCGAGKSLVGVTAACTVRKRCLVLGNSAVSVEQWKAQFKMWSTIDDSQICRFTSDAKDKPIGCSVAISTYSMLGHTTKRSWEAERVMEWLKTQEWGLMILDEVHTIPAKMFRRVLTIVQAHCKLGLTATLVREDDKIVDLNFLIGPKLYEANWMELQNNGYIAKVQCAEVWCPMSPEFYREYVAIKTKKRILLYTMNPNKFRACQFLIKFHERRNDKIIVFADNVFALKEYAIRLNKPYIYGPTSQGERMQILQNFKHNPKINTIFISKVGDTSFDLPEANVLIQISSHGGSRRQEAQRLGRVLRAKKGMVAEEYNAFFYSLVSQDTQEMAYSTKRQRFLVDQGYSFKVITKLAGMEEEDLAFSTKEEQQQLLQKVLAATDLDAEEEVVAGEFGSRSSQASRRFGTMSSMSGADDTVYMEYHSSRSKAPSKHVHPLFKRFRK

SEQ ID NO: 377 - protein, 940 aa, Homo sapiens
MARKRAAGGEPRGRELRSQKSKAKSKARREEEEEDAFEDEKPPKKSLLSKVSQGKRKRGCSHPGGSADGPAKKKVAKVTVKSENLKVIKDEALSDGDDLRDFPSDLKKAHHLKRGATMNEDSNEEEEESENDWEEVEELSEPVLGDVRESTAFSRSLLPVKPVEIEIETPEQAKTRERSEKIKLEFETYLRRAMKRFNKGVHEDTHKVHLLCLLANGFYRNNICSQPDLHAIGLSIIPARFTRVLPRDVDTYYLSNLVKWFIGTFTVNAELSASEQDNLQTTLERRFAIYSARDDEELVHIFLLILRALQLLTRLVLSLQPIPLKSATAKGKKPSKERLTADPGGSSETSSQVLENHTKPKTSKGTKQEETFAKGTCRPSAKGKRNKGGRKKRSKPSSSEEDEGPGDKQEKATQRRPHGRERRVASRVSYKEESGSDEAGSGSDFELSSGEASDPSDEDSEPGPPKQRKAPAPQRTKAGSKSASRTHRGSHRKDPSLPAASSSSSSSKRGKKMCSDGEKAEKRSIAGIDQWLEVFCEQEEKWVCVDCVHGVVGQPLTCYKYATKPMTYVVGIDSDGWVRDVTQRYDPVWMTVTRKCRVDAEWWAETLRPYQSPFMDREKKEDLEFQAKHMDQPLPTAIGLYKNHPLYALKRHLLKYEAIYPETAAILGYCRGEAVYSRDCVHTLHSRDTWLKKARVVRLGEVPYKMVKGFSNRARKARLAEPQLREENDLGLFGYWQTEEYQPPVAVDGKVPRNEFGNVYLFLPSMMPIGCVQLNLPNLHRVARKLDIDCVQAITGFDFHGGYSHPVTDGYIVCEEFKDVLLTAWENEQAVIERKEKEKKEKRALGNWKLLAKGLLIRERLKRRYGPKSEAAAPHTDAGGGLSSDEEEGTSSQAEAARILAASWPQNREDEEKQKLKGGPKKTKREKKAAASHLFPFEQL

SEQ ID NO: 378 - protein, 903 aa, Homo sapiens
MARKRAAGGEPRGRELRSQKSKAKSKARREEEEEDAFEDEKPPKKSLLSKVSQGKRKRGCSHPGGSADGPAKKKVAKVTVKSENLKVIKDEALSDGDDLRDFPSDLKKAHHLKRGATMNEDSNEEEEESENDWEEAKTRERSEKIKLEFETYLRRAMKRFNKGVHEDTHKVHLLCLLANGFYRNNICSQPDLHAIGLSIIPARFTRVLPRDVDTYYLSNLVKWFIGTFTVNAELSASEQDNLQTTLERRFAIYSARDDEELVHIFLLILRALQLLTRLVLSLQPIPLKSATAKGKKPSKERLTADPGGSSETSSQVLENHTKPKTSKGTKQEETFAKGTCRPSAKGKRNKGGRKKRSKPSSSEEDEGPGDKQEKATQRRPHGRERRVASRVSYKEESGSDEAGSGSDFELSSGEASDPSDEDSEPGPPKQRKAPAPQRTKAGSKSASRTHRGSHRKDPSLPAASSSSSSSKRGKKMCSDGEKAEKRSIAGIDQWLEVFCEQEEKWVCVDCVHGVVGQPLTCYKYATKPMTYVVGIDSDGWVRDVTQRYDPVWMTVTRKCRVDAEWWAETLRPYQSPFMDREKKEDLEFQAKHMDQPLPTAIGLYKNHPLYALKRHLLKYEAIYPETAAILGYCRGEAVYSRDCVHTLHSRDTWLKKARVVRLGEVPYKMVKGFSNRARKARLAEPQLREENDLGLFGYWQTEEYQPPVAVDGKVPRNEFGNVYLFLPSMMPIGCVQLNLPNLHRVARKLDIDCVQAITGFDFHGGYSHPVTDGYIVCEEFKDVLLTAWENEQAVIERKEKEKKEKRALGNWKLLAKGLLIRERLKRRYGPKSEAAAPHTDAGGGLSSDEEEGTSSQAEAARILAASWPQNREDEEKQKLKGGPKKTKREKKAAASHLFPFEQL

SEQ ID NO: 379 - protein, 140 aa, Homo sapiens
MARKRAAGGEPRGRELRSQKSKAKSKARREEEEEDAFEDEKPPKKSLLSKVSQGKRKRGCSHPGGSADGPAKKKVAKVTVKSENLKVIKDEALSDGDDLRDFPSDLKKAHHLKRGATMNEDSNEEEEESENDWEEVEVKR

SEQ ID NO: 380 - protein, 760 aa, Homo sapiens
MKLNVDGLLVYFPYDYIYPEQFSYMRELKRTLDAKGHGVLEMPSGTGKTVSLLALIMAYQRAYPLEVTKLIYCSRTVPEIEKVIEELRKLLNFYEKQEGEKLPFLGLALSSRKNLCIHPEVTPLRFGKDVDGKCHSLTASYVRAQYQHDTSLPHCRFYEEFDAHGREVPLPAGIYNLDDLKALGRRQGWCPYFLARYSILHANVVVYSYHYLLDPKIADLVSKELARKAVVVFDEAHNIDNVCIDSMSVNLTRRTLDRCQGNLETLQKTVLRIKETDEQRLRDEYRRLVEGLREASAARETDAHLANPVLPDEVLQEAVPGSIRTAEHFLGFLRRLLEYVKWRLRVQHVVQESPPAFLSGLAQRVCIQRKPLRFCAERLRSLLHTLEITDLADFSPLTLLANFATLVSTYAKGFTIIIEPFDDRTPTIANPILHFSCMDASLAIKPVFERFQSVIITSGTLSPLDIYPKILDFHPVTMATFTMTLARVCLCPMIIGRGNDQVAISSKFETREDIAVIRNYGNLLLEMSAVVPDGIVAFFTSYQYMESTVASWYEQGILENIQRNKLLFIETQDGAETSVALEKYQEACENGRGAILLSVARGKVSEGIDFVHHYGRAVIMFGVPYVYTQSRILKARLEYLRDQFQIRENDFLTFDAMRHAAQCVGRAIRGKTDYGLMVFADKRFARGDKRGKLPRWIQEHLTDANLNLTVDEGVQVAKYFLRQMAQPFHREDQLGLSLLSLEQLESEETLKRIEQIAQQL

SEQ ID NO: 381 - protein, 405 aa, Homo sapiens
MRELKRTLDAKGHGVLEMPSGTGKTVSLLALIMAYQRAYPLEVTKLIYCSRTVPEIEKVIEELRKLLNFYEKQEGEKLPFLGLALSSRKNLCIHPEVTPLRFGKDVDGKCHSLTASYVRAQYQHDTSLPHCRFYEEFDAHGREVPLPAGIYNLDDLKALGRRQGWCPYFLARYSILHANVVVYSYHYLLDPKIADLVSKELARKAVVVFDEAHNIDNVCIDSMSVNLTRRTLDRCQGNLETLQKTVLRIKETDEQRLRDEYRRLVEGLREASAARETDAHLANPVLPDEVLQEAVPGSIRTAEHFLGFLRRLLEYVKWRLRVQHVVQESPPAFLSGLAQRVCIQRKPLRFCAERLRSLLHTLEITDLADFSPLTLLANFATLVSTYAKGQAQHCGSSRNQKRSHP

SEQ ID NO: 382 - protein, 1186 aa, Homo sapiens
MGVQGLWKLLECSGRQVSPEALEGKILAVDISIWLNQALKGVRDRHGNSIENPHLLTLFHRLCKLLFFRIRPIFVFDGDAPLLKKQTLVKRRQRKDLASSDSRKTTEKLLKTFLKRQAIKTAFRSKRDEALPSLTQVRRENDLYVLPPLQEEEKHSSEEEDEKEWQERMNQKQALQEEFFHNPQAIDIESEDFSSLPPEVKHEILTDMKEFTKRRRTLFEAMPEESDDFSQYQLKGLLKKNYLNQHIEHVQKEMNQQHSGHIRRQYEDEGGFLKEVESRRVVSEDTSHYILIKGIQAKTVAEVDSESLPSSSKMHGMSFDVKSSPCEKLKTEKEPDATPPSPRTLLAMQAALLGSSSEEELESENRRQARGRNAPAAVDEGSISPRTLSAIKRALDDDEDVKVCAGDDVQTGGPGAEEMRINSSTENSDEGLKVRDGKGIPFTATLASSSVNSAEEHVASTNEGREPTDSVPKEQMSLVHVGTEAFPISDESMIKDRKDRLPLESAVVRHSDAPGLPNGRELTPASPTCTNSVSKNETHAEVLEQQNELCPYESKFDSSLLSSDDETKCKPNSASEVIGPVSLQETSSIVSVPSEAVDNVENVVSFNAKEHENFLETIQEQQTTESAGQDLISIPKAVEPMEIDSEESESDGSFIEVQSVISDEELQAEFPETSKPPSEQGEEELVGTREGEAPAESESLLRDNSERDDVDGEPQEAEKDAEDSLHEWQDINLEELETLESNLLAQQNSLKAQKQQQERIAATVTGQMFLESQELLRLFGIPYIQAPMEAEAQCAILDLTDQTSGTITDDSDIWLFGARHVYRNFFNKNKFVEYYQYVDFHNQLGLDRNKLINLAYLLGSDYTEGIPTVGCVTAMEILNEFPGHGLEPLLKFSEWWHEAQKNPKIRPNPHDTKVKKKLRTLQLTPGFPNPAVAEAYLKPVVDDSKGSFLWGKPDLDKIREFCQRYFGWNRTKTDESLFPVLKQLDAQQTQLRIDSFFRLAQQEKEDAKRIKSQRLNRAVTCMLRKEKEAAASEIEAVSVAMEKEFELLDKAKGKTQKRGITNTLEESSSLKRKRLSDSKGKNTCGGFLGETCLSESSDGSSSEDAESSSLMNVQRRTAAKEPKTSASDSQNSVKEAPVKNGGATTSSSSDSDDDGGKEKMVLVTARSVFGKKRRKLRRARGRKRKT

SEQ ID NO: 383 - protein, 71 aa, Homo sapiens
MVNVLKGVLIECDPAMKQFLLYLDESNALGKKFIIQDIDDTHVFVIAELVNVLQERVGELMDQNAFSLTQK

SEQ ID NO: 384 - protein, 709 aa, Homo sapiens
MDQKLSKLVEELTTSGEPRLNPEKMKELKKICKSSEEQLSRAYRLLIAQLTQEHAEIRLSAFQIVEELFVRSHQFRMLVVSNFQEFLELTLGTDPAQPLPPPREAAQRLRQATTRAVEGWNEKFGEAYKKLALGYHFLRHNKKVDFQDTNARSLAERKREEEKQKHLDKIYQERASQAEREMQEMSGEIESCLTEVESCFRLLVPFDFDPNPETESLGMASGMSDALRSSCAGQVGPCRSGTPDPRDGEQPCCSRDLPASAGHPRAGGGAQPSQTATGDPSDEDEDSDLEEFVRSHGLGSHKYTLDVELCSEGLKVQENEDNLALIHAARDTLKLIRNKFLPAVCSWIQRFTRVGTHGGCLKRAIDLKAELELVLRKYKELDIEPEGGERRRTEALGDAEEDEDDEDFVEVPEKEGYEPHIPDHLRPEYGLEAAPEKDTVVRCLRTRTRMDEEVSDPTSAAAQLRQLRDHLPPPSSASPSRALPEPQEAQKLAAERARAPVVPYGVDLHYWGQELPTAGKIVKSDSQHRFWKPSEVEEEVVNADISEMLRSRHITFAGKFEPVQHWCRAPRPDGRLCERQDRLKCPFHGKIVPRDDEGRPLDPEDRAREQRRQLQKQERPEWQDPELMRDVEAATGQDLGSSRYSGKGRGKKRRYPSLTNLKAQADTARARIGRKVFAKAAVRRVVAAMNRMDQKKHEKFSNQFNYALN

SEQ ID NO: 385 - protein, 260 aa, Homo sapiens
MDEEVSDPTSAAAQLRQLRDHLPPPSSASPSRALPEPQEAQKLAAERARAPVVPYGVDLHYWGQELPTAGKIVKSDSQHRFWKPSEVEEEVVNADISEMLRSRHITFAGKFEPVQHWCRAPRPDGRLCERQDRLKCPFHGKIVPRDDEGRPLDPEDRAREQRRQLQKQERPEWQDPELMRDVEAATGQDLGSSRYSGKGRGKKRRYPSLTNLKAQADTARARIGRKVFAKAAVRRVVAAMNRMDQKKHEKFSNQFNYALN

SEQ ID NO: 386 - protein, 1102 aa, Homo sapiens
MNHQQQQQQQKAGEQQLSEPEDMEMEAGDTDDPPRITQNPVINGNVALSDGHNTAEEDMEDDTSWRSEATFQFTVERFSRLSESVLSPPCFVRNLPWKIMVMPRFYPDRPHQKSVGFFLQCNAESDSTSWSCHAQAVLKIINYRDDEKSFSRRISHLFFHKENDWGFSNFMAWSEVTDPEKGFIDDDKVTFEVFVQADAPHGVAWDSKKHTGYVGLKNQGATCYMNSLLQTLFFTNQLRKAVYMMPTEGDDSSKSVPLALQRVFYELQHSDKPVGTKKLTKSFGWETLDSFMQHDVQELCRVLLDNVENKMKGTCVEGTIPKLFRGKMVSYIQCKEVDYRSDRREDYYDIQLSIKGKKNIFESFVDYVAVEQLDGDNKYDAGEHGLQEAEKGVKFLTLPPVLHLQLMRFMYDPQTDQNIKINDRFEFPEQLPLDEFLQKTDPKDPANYILHAVLVHSGDNHGGHYVVYLNPKGDGKWCKFDDDVVSRCTKEEAIEHNYGGHDDDLSVRHCTNAYMLVYIRESKLSEVLQAVTDHDIPQQLVERLQEEKRIEAQKRKERQEAHLYMQVQIVAEDQFCGHQGNDMYDEEKVKYTVFKVLKNSSLAEFVQSLSQTMGFPQDQIRLWPMQARSNGTKRPAMLDNEADGNKTMIELSDNENPWTIFLETVDPELAASGATLPKFDKDHDVMLFLKMYDPKTRSLNYCGHIYTPISCKIRDLLPVMCDRAGFIQDTSLILYEEVKPNLTERIQDYDVSLDKALDELMDGDIIVFQKDDPENDNSELPTAKEYFRDLYHRVDVIFCDKTIPNDPGFVVTLSNRMNYFQVAKTVAQRLNTDPMLLQFFKSQGYRDGPGNPLRHNYEGTLRDLLQFFKPRQPKKLYYQQLKMKITDFENRRSFKCIWLNSQFREEEITLYPDKHGCVRDLLEECKKAVELGEKASGKLRLLEIVSYKIIGVHQEDELLECLSPATSRTFRIEEIPLDQVDIDKENEMLVTVAHFHKEVFGTFGIPFLLRIHQGEHFREVMKRIQSLLDIQEKEFEKFKFAIVMMGRHQYINEDEYEVNLKDFEPQPGNMSHPRPWLGLDHFNKAPKRSRYTYLEKAIKIHN

SEQ ID NO: 387 - RNA, 20 nt, Artificial Sequence
  Synthetic
gaccuagggaucgaucugga

SEQ ID NO: 388 - RNA, 20 nt, Artificial Sequence
  Synthetic
gaccucuagcucgagcgcga

SEQ ID NO: 389 - RNA, 20 nt, Artificial Sequence
  Synthetic
gacgggaaagggggaguucg

SEQ ID NO: 390 - RNA, 20 nt, Artificial Sequence
  Synthetic
gagcgcgagggaccucccgc

SEQ ID NO: 391 - RNA, 20 nt, Artificial Sequence
  Synthetic
gaguucgcggccgguggcgg

SEQ ID NO: 392 - RNA, 20 nt, Artificial Sequence
  Synthetic
gaucgaucuggagggacuug

SEQ ID NO: 393 - RNA, 20 nt, Artificial Sequence
  Synthetic
gcugucgccaccgccgccac

SEQ ID NO: 394 - RNA, 20 nt, Artificial Sequence
  Synthetic
ggaaagggggaguucgcggc

SEQ ID NO: 395 - RNA, 20 nt, Artificial Sequence
  Synthetic
ggaccucccgccgggaugcc

SEQ ID NO: 396 - RNA, 20 nt, Artificial Sequence
  Synthetic
ggaucgaucuggagggacuu

SEQ ID NO: 397 - RNA, 20 nt, Artificial Sequence
  Synthetic
gggaucgaucuggagggacu

SEQ ID NO: 398 - RNA, 20 nt, Artificial Sequence
  Synthetic
gggauuucuugaguggcggg

SEQ ID NO: 399 - RNA, 20 nt, Artificial Sequence
  Synthetic
ggggaguucgcggccggugg

SEQ ID NO: 400 - RNA, 20 nt, Artificial Sequence
  Synthetic
gguacuguuuggagagaaau

SEQ ID NO: 401 - RNA, 20 nt, Artificial Sequence
  Synthetic
gguggcgacagcggcgaccu

SEQ ID NO: 402 - RNA, 20 nt, Artificial Sequence
  Synthetic
guaccaggcaucccggcggg

SEQ ID NO: 403 - RNA, 20 nt, Artificial Sequence
  Synthetic
gucccuccagaucgaucccu

SEQ ID NO: 404 - RNA, 20 nt, Artificial Sequence
  Synthetic
gucccucgcgcucgagcuag

SEQ ID NO: 405 - RNA, 20 nt, Artificial Sequence
  Synthetic
guggcgacagcggcgaccua

SEQ ID NO: 406 - RNA, 20 nt, Artificial Sequence
  Synthetic
gugugacgugacgggaaagg

SEQ ID NO: 407 - RNA, 20 nt, Artificial Sequence
  Synthetic
aacaguaccaggcaucccgg

SEQ ID NO: 408 - RNA, 20 nt, Artificial Sequence
  Synthetic
aagggggaguucgcggccgg

SEQ ID NO: 409 - RNA, 20 nt, Artificial Sequence
  Synthetic
acaguaccaggcaucccggc

SEQ ID NO: 410 - RNA, 20 nt, Artificial Sequence
  Synthetic
agaccucuagcucgagcgcg

SEQ ID NO: 411 - RNA, 20 nt, Artificial Sequence
  Synthetic
agcgcgagggaccucccgcc

SEQ ID NO: 412 - RNA, 20 nt, Artificial Sequence
  Synthetic
auugugugacgugacgggaa

SEQ ID NO: 413 - RNA, 20 nt, Artificial Sequence
  Synthetic
auuucuugaguggcgggcgg

SEQ ID NO: 414 - RNA, 20 nt, Artificial Sequence
  Synthetic
caagaaaucccguggaugau

SEQ ID NO: 415 - RNA, 20 nt, Artificial Sequence
  Synthetic
cauccacgggauuucuugag

SEQ ID NO: 416 - RNA, 20 nt, Artificial Sequence
  Synthetic
cccgucacgucacacaauau

SEQ ID NO: 417 - RNA, 20 nt, Artificial Sequence
  Synthetic
ccgauauugugugacgugac

SEQ ID NO: 418 - RNA, 20 nt, Artificial Sequence
  Synthetic
ccgcagcuaccuaucaucca

SEQ ID NO: 419 - RNA, 20 nt, Artificial Sequence
  Synthetic
ccgccacucaagaaaucccg

SEQ ID NO: 420 - RNA, 20 nt, Artificial Sequence
  Synthetic
ccgggaugccugguacuguu

SEQ ID NO: 421 - RNA, 20 nt, Artificial Sequence
  Synthetic
ccguggaugauagguagcug

SEQ ID NO: 422 - RNA, 20 nt, Artificial Sequence
  Synthetic
cgaccuagggaucgaucugg

SEQ ID NO: 423 - RNA, 20 nt, Artificial Sequence
  Synthetic
cgcagcuaccuaucauccac

SEQ ID NO: 424 - RNA, 20 nt, Artificial Sequence
  Synthetic
cggcgaccuagggaucgauc

SEQ ID NO: 425 - RNA, 20 nt, Artificial Sequence
  Synthetic
uccgauauugugugacguga

SEQ ID NO: 426 - RNA, 20 nt, Artificial Sequence
  Synthetic
uggcgggcggcggcagcgaa

SEQ ID NO: 427 - RNA, 22 nt, Artificial Sequence
  Synthetic
gagugcagugggcucugaaggc

SEQ ID NO: 428 - RNA, 22 nt, Artificial Sequence
  Synthetic
gcgguggcgacagcggcgaccu

SEQ ID NO: 429 - RNA, 22 nt, Artificial Sequence
  Synthetic
cgcccgccacucaagaaauccc

SEQ ID NO: 430 - RNA, 22 nt, Artificial Sequence
  Synthetic
cguggaugauagguagcugcgg

SEQ ID NO: 431 - RNA, 22 nt, Artificial Sequence
  Synthetic
cugguacuguuuggagagaaau

SEQ ID NO: 432 - RNA, 22 nt, Artificial Sequence
  Synthetic
uaccuaucauccacgggauuuc

SEQ ID NO: 433 - RNA, 22 nt, Artificial Sequence
  Synthetic
ucgagcgcgagggaccucccgc

SEQ ID NO: 434 - RNA, 22 nt, Artificial Sequence
  Synthetic
ucuugaguggcgggcggcggca

SEQ ID NO: 435 - RNA, 22 nt, Artificial Sequence
  Synthetic
ugccgcagcuaccuaucaucca

SEQ ID NO: 436 - RNA, 22 nt, Artificial Sequence
  Synthetic
uugugugacgugacgggaaagg

SEQ ID NO: 437 - RNA, 22 nt, Artificial Sequence
  Synthetic
uuucccgucacgucacacaaua

SEQ ID NO: 438 - RNA, 20 nt, Artificial Sequence
  Synthetic
gaacgaggcaucucgccgcg

SEQ ID NO: 439 - RNA, 20 nt, Artificial Sequence
  Synthetic
gagcucgacuuucccagcuc

SEQ ID NO: 440 - RNA, 20 nt, Artificial Sequence
  Synthetic
gauaaauaucggggugacag

SEQ ID NO: 441 - RNA, 20 nt, Artificial Sequence
  Synthetic
gcccaggagugcgcgggagu

SEQ ID NO: 442 - RNA, 20 nt, Artificial Sequence
  Synthetic
gccgccaucuuggucuagga

SEQ ID NO: 443 - RNA, 20 nt, Artificial Sequence
  Synthetic
gcgcgggaguagguuaggcc

SEQ ID NO: 444 - RNA, 20 nt, Artificial Sequence
  Synthetic
ggaggagaucggcggagggc

SEQ ID NO: 445 - RNA, 20 nt, Artificial Sequence
  Synthetic
ggagugcgcgggaguagguu

SEQ ID NO: 446 - RNA, 20 nt, Artificial Sequence
  Synthetic
ggcagacugaggguuccccg

SEQ ID NO: 447 - RNA, 20 nt, Artificial Sequence
  Synthetic
ggcaucucgccgcgaggggg

SEQ ID NO: 448 - RNA, 20 nt, Artificial Sequence
  Synthetic
ggcccgcccagccgccaucu

SEQ ID NO: 449 - RNA, 20 nt, Artificial Sequence
  Synthetic
ggcgagaugccucguucccc

SEQ ID NO: 450 - RNA, 20 nt, Artificial Sequence
  Synthetic
gggaggagaucggcggaggg

SEQ ID NO: 451 - RNA, 20 nt, Artificial Sequence
  Synthetic
gggaguagguuaggccuggc

SEQ ID NO: 452 - RNA, 20 nt, Artificial Sequence
  Synthetic
gggcagcuuucaacagaggg

SEQ ID NO: 453 - RNA, 20 nt, Artificial Sequence
  Synthetic
ggggugacagugguaggccg

SEQ ID NO: 454 - RNA, 20 nt, Artificial Sequence
  Synthetic
gggugacagugguaggccgc

SEQ ID NO: 455 - RNA, 20 nt, Artificial Sequence
  Synthetic
ggugacagugguaggccgcg

SEQ ID NO: 456 - RNA, 20 nt, Artificial Sequence
  Synthetic
gucgagcucuggcagcgucu

SEQ ID NO: 457 - RNA, 20 nt, Artificial Sequence
  Synthetic
gugaguaaacagccggagcu

SEQ ID NO: 458 - RNA, 20 nt, Artificial Sequence
  Synthetic
aaccuacucccgcgcacucc

SEQ ID NO: 459 - RNA, 20 nt, Artificial Sequence
  Synthetic
aacgaggcaucucgccgcga

SEQ ID NO: 460 - RNA, 20 nt, Artificial Sequence
  Synthetic
aauaucggggugacaguggu

SEQ ID NO: 461 - RNA, 20 nt, Artificial Sequence
  Synthetic
acgaggcaucucgccgcgag

SEQ ID NO: 462 - RNA, 20 nt, Artificial Sequence
  Synthetic
agggaggcgaucgauaacuc

SEQ ID NO: 463 - RNA, 20 nt, Artificial Sequence
  Synthetic
agucgagcucuggcagcguc

SEQ ID NO: 464 - RNA, 20 nt, Artificial Sequence
  Synthetic
ccaccuaggaagaucaggac

SEQ ID NO: 465 - RNA, 20 nt, Artificial Sequence
  Synthetic
ccccgauauuuaucccaccu

SEQ ID NO: 466 - RNA, 20 nt, Artificial Sequence
  Synthetic
ccuagaccaagauggcggcu

SEQ ID NO: 467 - RNA, 20 nt, Artificial Sequence
  Synthetic
cgaggcaucucgccgcgagg

SEQ ID NO: 468 - RNA, 20 nt, Artificial Sequence
  Synthetic
cgcacgcgugaguaaacagc

SEQ ID NO: 469 - RNA, 20 nt, Artificial Sequence
  Synthetic
cggcgagaugccucguuccc

SEQ ID NO: 470 - RNA, 20 nt, Artificial Sequence
  Synthetic
cgugaguaaacagccggagc

SEQ ID NO: 471 - RNA, 20 nt, Artificial Sequence
  Synthetic
uccaacagucagcggcacac

SEQ ID NO: 472 - RNA, 20 nt, Artificial Sequence
  Synthetic
uccggugugccgcugacugu

SEQ ID NO: 473 - RNA, 20 nt, Artificial Sequence
  Synthetic
ucucgccgcgagggggcgga

SEQ ID NO: 474 - RNA, 20 nt, Artificial Sequence
  Synthetic
uggcucgaacuucucccgcc

SEQ ID NO: 475 - RNA, 20 nt, Artificial Sequence
  Synthetic
ugugccgcugacuguuggau

SEQ ID NO: 476 - RNA, 20 nt, Artificial Sequence
  Synthetic
uuaucccaccuaggaagauc

SEQ ID NO: 477 - RNA, 20 nt, Artificial Sequence
  Synthetic
uuccuaggugggauaaauau

SEQ ID NO: 478 - RNA, 22 nt, Artificial Sequence
  Synthetic
gaaagucgagcucuggcagcgu

SEQ ID NO: 479 - RNA, 22 nt, Artificial Sequence
  Synthetic
ggcaucucgccgcgagggggcg

SEQ ID NO: 480 - RNA, 22 nt, Artificial Sequence
  Synthetic
gggggcggagggugggcagacu

SEQ ID NO: 481 - RNA, 22 nt, Artificial Sequence
  Synthetic
aacuccggugugccgcugacug

SEQ ID NO: 482 - RNA, 22 nt, Artificial Sequence
  Synthetic
aagauggcggcugggcgggccc

SEQ ID NO: 483 - RNA, 22 nt, Artificial Sequence
  Synthetic
aauccaacagucagcggcacac

SEQ ID NO: 484 - RNA, 22 nt, Artificial Sequence
  Synthetic
acccuguccugaucuuccuagg

SEQ ID NO: 485 - RNA, 22 nt, Artificial Sequence
  Synthetic
aucccaccuaggaagaucagga

SEQ ID NO: 486 - RNA, 22 nt, Artificial Sequence
  Synthetic
cugggcgggcccaggagugcgc

SEQ ID NO: 487 - RNA, 22 nt, Artificial Sequence
  Synthetic
uaggagggagcgcgccgcacgc

SEQ ID NO: 488 - RNA, 22 nt, Artificial Sequence
  Synthetic
ucuuccuaggugggauaaauau

SEQ ID NO: 489 - RNA, 20 nt, Artificial Sequence
  Synthetic
gaacaucuccucaggaacuu

SEQ ID NO: 490 - RNA, 20 nt, Artificial Sequence
  Synthetic
gcccccacucgccccgccaa

SEQ ID NO: 491 - RNA, 20 nt, Artificial Sequence
  Synthetic
gccguuggcggggcgagugg

SEQ ID NO: 492 - RNA, 20 nt, Artificial Sequence
  Synthetic
gcgccgagcgcccgaagcgc

SEQ ID NO: 493 - RNA, 20 nt, Artificial Sequence
  Synthetic
gcgccgccgcggagccuccc

SEQ ID NO: 494 - RNA, 20 nt, Artificial Sequence
  Synthetic
gcgcgcggcucccgcgcuuc

SEQ ID NO: 495 - RNA, 20 nt, Artificial Sequence
  Synthetic
gcgcgggcagggccguuggc

SEQ ID NO: 496 - RNA, 20 nt, Artificial Sequence
  Synthetic
gcgcucccccucgguggccg

SEQ ID NO: 497 - RNA, 20 nt, Artificial Sequence
  Synthetic
gcgggauggugcgucccgca

SEQ ID NO: 498 - RNA, 20 nt, Artificial Sequence
  Synthetic
gcucccgcgcuucgggcgcu

SEQ ID NO: 499 - RNA, 20 nt, Artificial Sequence
  Synthetic
ggaccccgauucgcaggacc

SEQ ID NO: 500 - RNA, 20 nt, Artificial Sequence
  Synthetic
ggaccgggcccgggcugcgc

SEQ ID NO: 501 - RNA, 20 nt, Artificial Sequence
  Synthetic
ggccguuggcggggcgagug

SEQ ID NO: 502 - RNA, 20 nt, Artificial Sequence
  Synthetic
ggcgcucccccucgguggcc

SEQ ID NO: 503 - RNA, 20 nt, Artificial Sequence
  Synthetic
ggcgggauggugcgucccgc

SEQ ID NO: 504 - RNA, 20 nt, Artificial Sequence
  Synthetic
ggcugcgcgggcagggccgu

SEQ ID NO: 505 - RNA, 20 nt, Artificial Sequence
  Synthetic
gggagccgcgcgcgcccugc

SEQ ID NO: 506 - RNA, 20 nt, Artificial Sequence
  Synthetic
gggagcggaccccgauucgc

SEQ ID NO: 507 - RNA, 20 nt, Artificial Sequence
  Synthetic
gggcccgguccugcgaaucg

SEQ ID NO: 508 - RNA, 20 nt, Artificial Sequence
  Synthetic
gggccguuggcggggcgagu

SEQ ID NO: 509 - RNA, 20 nt, Artificial Sequence
  Synthetic
aacaucuccucaggaacuuu

SEQ ID NO: 510 - RNA, 20 nt, Artificial Sequence
  Synthetic
caugaucgcggcggcccggg

SEQ ID NO: 511 - RNA, 20 nt, Artificial Sequence
  Synthetic
ccaggcgcccaaaguuccug

SEQ ID NO: 512 - RNA, 20 nt, Artificial Sequence
  Synthetic
ccgacaugaucgcggcggcc

SEQ ID NO: 513 - RNA, 20 nt, Artificial Sequence
  Synthetic
ccgauucgcaggaccgggcc

SEQ ID NO: 514 - RNA, 20 nt, Artificial Sequence
  Synthetic
ccgggcccgguccugcgaau

SEQ ID NO: 515 - RNA, 20 nt, Artificial Sequence
  Synthetic
ccgggccgccgcgaucaugu

SEQ ID NO: 516 - RNA, 20 nt, Artificial Sequence
  Synthetic
ccucaggaacuuugggcgcc

SEQ ID NO: 517 - RNA, 20 nt, Artificial Sequence
  Synthetic
cgacaugaucgcggcggccc

SEQ ID NO: 518 - RNA, 20 nt, Artificial Sequence
  Synthetic
cgauucgcaggaccgggccc

SEQ ID NO: 519 - RNA, 20 nt, Artificial Sequence
  Synthetic
cgccgcgaucaugucggacc

SEQ ID NO: 520 - RNA, 20 nt, Artificial Sequence
  Synthetic
cgccugguccgacaugaucg

SEQ ID NO: 521 - RNA, 20 nt, Artificial Sequence
  Synthetic
cgcgccgagcgcccgaagcg

SEQ ID NO: 522 - RNA, 20 nt, Artificial Sequence
  Synthetic
cgcgcgcggcucccgcgcuu

SEQ ID NO: 523 - RNA, 20 nt, Artificial Sequence
  Synthetic
cgcgcuucgggcgcucggcg

SEQ ID NO: 524 - RNA, 20 nt, Artificial Sequence
  Synthetic
cggaccccgauucgcaggac

SEQ ID NO: 525 - RNA, 20 nt, Artificial Sequence
  Synthetic
cgggacgcaccaucccgccc

SEQ ID NO: 526 - RNA, 20 nt, Artificial Sequence
  Synthetic
cgggcccgguccugcgaauc

SEQ ID NO: 527 - RNA, 20 nt, Artificial Sequence
  Synthetic
cugguccgacaugaucgcgg

SEQ ID NO: 528 - RNA, 20 nt, Artificial Sequence
  Synthetic
ugcgucccgcagggcgcgcg

SEQ ID NO: 529 - RNA, 22 nt, Artificial Sequence
  Synthetic
gcccgggcccgguccugcgaau

SEQ ID NO: 530 - RNA, 22 nt, Artificial Sequence
  Synthetic
ggcgccgcgggggccgggggcg

SEQ ID NO: 531 - RNA, 22 nt, Artificial Sequence
  Synthetic
cgcgcagcccgggcccgguccu

SEQ ID NO: 532 - RNA, 22 nt, Artificial Sequence
  Synthetic
cgcgggcagggccguuggcggg

SEQ ID NO: 533 - RNA, 22 nt, Artificial Sequence
  Synthetic
cgcucccccucgguggccgggg

SEQ ID NO: 534 - RNA, 20 nt, Artificial Sequence
  Synthetic
gacgacaauccacgcaugcg

SEQ ID NO: 535 - RNA, 20 nt, Artificial Sequence
  Synthetic
gagcgaagcgggacgaggcc

SEQ ID NO: 536 - RNA, 20 nt, Artificial Sequence
  Synthetic
gaggcggcaccucgcguuug

SEQ ID NO: 537 - RNA, 20 nt, Artificial Sequence
  Synthetic
gagggcccacacggaagagg

SEQ ID NO: 538 - RNA, 20 nt, Artificial Sequence
  Synthetic
gaggugccgccuccuucccg

SEQ ID NO: 539 - RNA, 20 nt, Artificial Sequence
  Synthetic
gauaacggcccgcuuaccuu

SEQ ID NO: 540 - RNA, 20 nt, Artificial Sequence
  Synthetic
gcacaugcgugaugacguag

SEQ ID NO: 541 - RNA, 20 nt, Artificial Sequence
  Synthetic
gcaugcgcgggcccuguacu

SEQ ID NO: 542 - RNA, 20 nt, Artificial Sequence
  Synthetic
gcccccauagccuugcuaga

SEQ ID NO: 543 - RNA, 20 nt, Artificial Sequence
  Synthetic
gccccgccccuuccuacguc

SEQ ID NO: 544 - RNA, 20 nt, Artificial Sequence
  Synthetic
gcccgcuuaccuuuggcgca

SEQ ID NO: 545 - RNA, 20 nt, Artificial Sequence
  Synthetic
gccuuaagugugcgaauccg

SEQ ID NO: 546 - RNA, 20 nt, Artificial Sequence
  Synthetic
gcgagaccgaccgagcgaag

SEQ ID NO: 547 - RNA, 20 nt, Artificial Sequence
  Synthetic
ggacauagguagaagcuggu

SEQ ID NO: 548 - RNA, 20 nt, Artificial Sequence
  Synthetic
ggcccgcuuaccuuuggcgc

SEQ ID NO: 549 - RNA, 20 nt, Artificial Sequence
  Synthetic
gggcggggcuuugccgaagg

SEQ ID NO: 550 - RNA, 20 nt, Artificial Sequence
  Synthetic
ggggcggggcucucgcugau

SEQ ID NO: 551 - RNA, 20 nt, Artificial Sequence
  Synthetic
ggggcggggcuuugccgaag

SEQ ID NO: 552 - RNA, 20 nt, Artificial Sequence
  Synthetic
guacagggcccgcgcaugcg

SEQ ID NO: 553 - RNA, 20 nt, Artificial Sequence
  Synthetic
guugauugggaccgaguaca

SEQ ID NO: 554 - RNA, 20 nt, Artificial Sequence
  Synthetic
accacgcuccuuccucggga

SEQ ID NO: 555 - RNA, 20 nt, Artificial Sequence
  Synthetic
acgacaauccacgcaugcgc

SEQ ID NO: 556 - RNA, 20 nt, Artificial Sequence
  Synthetic
augacguagagggcguugau

SEQ ID NO: 557 - RNA, 20 nt, Artificial Sequence
  Synthetic
cacaugcgugaugacguaga

SEQ ID NO: 558 - RNA, 20 nt, Artificial Sequence
  Synthetic
cgaccgagcgaagcgggacg

SEQ ID NO: 559 - RNA, 20 nt, Artificial Sequence
  Synthetic
cgagaccgaccgagcgaagc

SEQ ID NO: 560 - RNA, 20 nt, Artificial Sequence
  Synthetic
cgcacuauaucgcgucaggc

SEQ ID NO: 561 - RNA, 20 nt, Artificial Sequence
  Synthetic
cgcccccauagccuugcuag

SEQ ID NO: 562 - RNA, 20 nt, Artificial Sequence
  Synthetic
cggggcucucgcugaugggu

SEQ ID NO: 563 - RNA, 20 nt, Artificial Sequence
  Synthetic
cguugauugggaccgaguac

SEQ ID NO: 564 - RNA, 20 nt, Artificial Sequence
  Synthetic
cuaacgcuaacccucuagca

SEQ ID NO: 565 - RNA, 20 nt, Artificial Sequence
  Synthetic
cucgucccgcuucgcucggu

SEQ ID NO: 566 - RNA, 20 nt, Artificial Sequence
  Synthetic
cugauggguuggcuuucguc

SEQ ID NO: 567 - RNA, 20 nt, Artificial Sequence
  Synthetic
ucccugcgccaaagguaagc

SEQ ID NO: 568 - RNA, 20 nt, Artificial Sequence
  Synthetic
uccucggauucgcacacuua

SEQ ID NO: 569 - RNA, 20 nt, Artificial Sequence
  Synthetic
ucgagucugucgcugcuccu

SEQ ID NO: 570 - RNA, 20 nt, Artificial Sequence
  Synthetic
ugacguagagggcguugauu

SEQ ID NO: 571 - RNA, 20 nt, Artificial Sequence
  Synthetic
uggucgcuucccugcgccaa

SEQ ID NO: 572 - RNA, 20 nt, Artificial Sequence
  Synthetic
ugugcgcacuauaucgcguc

SEQ ID NO: 573 - RNA, 20 nt, Artificial Sequence
  Synthetic
uguuguucgccagcuaggcc

SEQ ID NO: 574 - RNA, 22 nt, Artificial Sequence
  Synthetic
gaagggggcggggcucucgcug

SEQ ID NO: 575 - RNA, 22 nt, Artificial Sequence
  Synthetic
gccuagcuggcgaacaacacaa

SEQ ID NO: 576 - RNA, 22 nt, Artificial Sequence
  Synthetic
gcgcgcccccauagccuugcua

SEQ ID NO: 577 - RNA, 22 nt, Artificial Sequence
  Synthetic
ggacauagguagaagcugguug

SEQ ID NO: 578 - RNA, 22 nt, Artificial Sequence
  Synthetic
gguuagcguuagccuuaagugu

SEQ ID NO: 579 - RNA, 22 nt, Artificial Sequence
  Synthetic
gucucgagucugucgcugcucc

SEQ ID NO: 580 - RNA, 22 nt, Artificial Sequence
  Synthetic
acacggaagagggggcgggggc

SEQ ID NO: 581 - RNA, 22 nt, Artificial Sequence
  Synthetic
acguagagggcguugauuggga

SEQ ID NO: 582 - RNA, 22 nt, Artificial Sequence
  Synthetic
cgaguacagggcccgcgcaugc

SEQ ID NO: 583 - RNA, 22 nt, Artificial Sequence
  Synthetic
uucccgaggaaggagcgugguc

SEQ ID NO: 584 - RNA, 20 nt, Artificial Sequence
  Synthetic
gaagcgaguugcgacacggc

SEQ ID NO: 585 - RNA, 20 nt, Artificial Sequence
  Synthetic
gaccggcaacauggugcggu

SEQ ID NO: 586 - RNA, 20 nt, Artificial Sequence
  Synthetic
gacuugggcuuuacccggac

SEQ ID NO: 587 - RNA, 20 nt, Artificial Sequence
  Synthetic
gagaaugugcgcaugcucgg

SEQ ID NO: 588 - RNA, 20 nt, Artificial Sequence
  Synthetic
gagccgcuucguuuccugcu

SEQ ID NO: 589 - RNA, 20 nt, Artificial Sequence
  Synthetic
gcaccauguugccgguccuc

SEQ ID NO: 590 - RNA, 20 nt, Artificial Sequence
  Synthetic
gccgugucgcaacucgcuuc

SEQ ID NO: 591 - RNA, 20 nt, Artificial Sequence
  Synthetic
gcgccugaggaccggcaaca

SEQ ID NO: 592 - RNA, 20 nt, Artificial Sequence
  Synthetic
gcgcuuuggucgcuucuucc

SEQ ID NO: 593 - RNA, 20 nt, Artificial Sequence
  Synthetic
gcuaucugccgcuuguccac

SEQ ID NO: 594 - RNA, 20 nt, Artificial Sequence
  Synthetic
ggaaucugcgcgagcucggc

SEQ ID NO: 595 - RNA, 20 nt, Artificial Sequence
  Synthetic
ggagagaaugugcgcaugcu

SEQ ID NO: 596 - RNA, 20 nt, Artificial Sequence
  Synthetic
ggccggaaucugcgcgagcu

SEQ ID NO: 597 - RNA, 20 nt, Artificial Sequence
  Synthetic
ggcgcuuuggucgcuucuuc

SEQ ID NO: 598 - RNA, 20 nt, Artificial Sequence
  Synthetic
gggaaucugcgcaagcucgg

SEQ ID NO: 599 - RNA, 20 nt, Artificial Sequence
  Synthetic
gggaaucugcgcaugcucgg

SEQ ID NO: 600 - RNA, 20 nt, Artificial Sequence
  Synthetic
ggggcggggaaaccgugccc

SEQ ID NO: 601 - RNA, 20 nt, Artificial Sequence
  Synthetic
gguggacaagcggcagauag

SEQ ID NO: 602 - RNA, 20 nt, Artificial Sequence
  Synthetic
gugucgcaacucgcuuccgg

SEQ ID NO: 603 - RNA, 20 nt, Artificial Sequence
  Synthetic
guuuccugcuaggccugaaa

SEQ ID NO: 604 - RNA, 20 nt, Artificial Sequence
  Synthetic
accggaagcgaguugcgaca

SEQ ID NO: 605 - RNA, 20 nt, Artificial Sequence
  Synthetic
accggcaacauggugcgguc

SEQ ID NO: 606 - RNA, 20 nt, Artificial Sequence
  Synthetic
acgguuuccccgccccuuuc

SEQ ID NO: 607 - RNA, 20 nt, Artificial Sequence
  Synthetic
acucgcuuccgguggacaag

SEQ ID NO: 608 - RNA, 20 nt, Artificial Sequence
  Synthetic
acuugggcuuuacccggacu

SEQ ID NO: 609 - RNA, 20 nt, Artificial Sequence
  Synthetic
agaagcgaccaaagcgccug

SEQ ID NO: 610 - RNA, 20 nt, Artificial Sequence
  Synthetic
cauggugcggucggggaaua

SEQ ID NO: 611 - RNA, 20 nt, Artificial Sequence
  Synthetic
ccacacgcucccgacuacgg

SEQ ID NO: 612 - RNA, 20 nt, Artificial Sequence
  Synthetic
ccgccccuuucaggccuagc

SEQ ID NO: 613 - RNA, 20 nt, Artificial Sequence
  Synthetic
ccgccguagucgggagcgug

SEQ ID NO: 614 - RNA, 20 nt, Artificial Sequence
  Synthetic
ccggcaacauggugcggucg

SEQ ID NO: 615 - RNA, 20 nt, Artificial Sequence
  Synthetic
cgccgagcucgcgcagauuc

SEQ ID NO: 616 - RNA, 20 nt, Artificial Sequence
  Synthetic
cgcucccgacuacggcggaa

SEQ ID NO: 617 - RNA, 20 nt, Artificial Sequence
  Synthetic
cguuuccugcuaggccugaa

SEQ ID NO: 618 - RNA, 20 nt, Artificial Sequence
  Synthetic
cucuccauuccgccguaguc

SEQ ID NO: 619 - RNA, 20 nt, Artificial Sequence
  Synthetic
cugcgcaugcucagaguucc

SEQ ID NO: 620 - RNA, 20 nt, Artificial Sequence
  Synthetic
ucucuccauuccgccguagu

SEQ ID NO: 621 - RNA, 20 nt, Artificial Sequence
  Synthetic
ugcgcaugcucagaguuccg

SEQ ID NO: 622 - RNA, 20 nt, Artificial Sequence
  Synthetic
uugccgguccucaggcgcuu

SEQ ID NO: 623 - RNA, 20 nt, Artificial Sequence
  Synthetic
uuuggucgcuucuuccgggc

SEQ ID NO: 624 - RNA, 22 nt, Artificial Sequence
  Synthetic
gaccggcaacauggugcggucg

SEQ ID NO: 625 - RNA, 22 nt, Artificial Sequence
  Synthetic
agagaaucugcgcaugcucggc

SEQ ID NO: 626 - RNA, 22 nt, Artificial Sequence
  Synthetic
agagaaugugcgcaugcucggc

SEQ ID NO: 627 - RNA, 22 nt, Artificial Sequence
  Synthetic
aucugccgcuuguccaccggaa

SEQ ID NO: 628 - RNA, 22 nt, Artificial Sequence
  Synthetic
caccacacgcucccgacuacgg

SEQ ID NO: 629 - RNA, 22 nt, Artificial Sequence
  Synthetic
ccggaaucugcgcgagcucggc

SEQ ID NO: 630 - RNA, 22 nt, Artificial Sequence
  Synthetic
cgggaaucugcgcaagcucggc

SEQ ID NO: 631 - RNA, 22 nt, Artificial Sequence
  Synthetic
cgggaaucugcgcaugcucgga

SEQ ID NO: 632 - RNA, 22 nt, Artificial Sequence
  Synthetic
cgggaaucugcgcaugcucggc

SEQ ID NO: 633 - RNA, 22 nt, Artificial Sequence
  Synthetic
cucccgacuacggcggaaugga

SEQ ID NO: 634 - RNA, 22 nt, Artificial Sequence
  Synthetic
ucggcgggaaucugcgcaugcu

SEQ ID NO: 635 - RNA, 20 nt, Artificial Sequence
  Synthetic
gcacgcgcgggagcgggacu

SEQ ID NO: 636 - RNA, 20 nt, Artificial Sequence
  Synthetic
gcagccccgccuccgcgcgu

SEQ ID NO: 637 - RNA, 20 nt, Artificial Sequence
  Synthetic
gccuucccgcaggggucccc

SEQ ID NO: 638 - RNA, 20 nt, Artificial Sequence
  Synthetic
gcgcccgcucggcccggacc

SEQ ID NO: 639 - RNA, 20 nt, Artificial Sequence
  Synthetic
gcgcgugcgcccgcucggcc

SEQ ID NO: 640 - RNA, 20 nt, Artificial Sequence
  Synthetic
gcggcggcaggaacuuuccc

SEQ ID NO: 641 - RNA, 20 nt, Artificial Sequence
  Synthetic
gcgggacucggcggcauggc

SEQ ID NO: 642 - RNA, 20 nt, Artificial Sequence
  Synthetic
gcgggcgcacgcgcgggagc

SEQ ID NO: 643 - RNA, 20 nt, Artificial Sequence
  Synthetic
ggaaaugccccuacgcgcgg

SEQ ID NO: 644 - RNA, 20 nt, Artificial Sequence
  Synthetic
ggagcaacgcacaccggcuc

SEQ ID NO: 645 - RNA, 20 nt, Artificial Sequence
  Synthetic
ggcauggcgggcuccggagc

SEQ ID NO: 646 - RNA, 20 nt, Artificial Sequence
  Synthetic
ggccaaagaggcgcgcuuac

SEQ ID NO: 647 - RNA, 20 nt, Artificial Sequence
  Synthetic
ggccaguaagcgcgccucuu

SEQ ID NO: 648 - RNA, 20 nt, Artificial Sequence
  Synthetic
ggccgagcgggcgcacgcgc

SEQ ID NO: 649 - RNA, 20 nt, Artificial Sequence
  Synthetic
ggccuucccgcagggguccc

SEQ ID NO: 650 - RNA, 20 nt, Artificial Sequence
  Synthetic
gggaccccugcgggaaggcc

SEQ ID NO: 651 - RNA, 20 nt, Artificial Sequence
  Synthetic
gggagcgggacucggcggca

SEQ ID NO: 652 - RNA, 20 nt, Artificial Sequence
  Synthetic
gggccgagcgggcgcacgcg

SEQ ID NO: 653 - RNA, 20 nt, Artificial Sequence
  Synthetic
guaggggcauuuccgggucc

SEQ ID NO: 654 - RNA, 20 nt, Artificial Sequence
  Synthetic
gugugcguugcucccugcug

SEQ ID NO: 655 - RNA, 20 nt, Artificial Sequence
  Synthetic
aagaggcgcgcuuacuggcc

SEQ ID NO: 656 - RNA, 20 nt, Artificial Sequence
  Synthetic
aaugccccuacgcgcggagg

SEQ ID NO: 657 - RNA, 20 nt, Artificial Sequence
  Synthetic
acuuucccggggaccccugc

SEQ ID NO: 658 - RNA, 20 nt, Artificial Sequence
  Synthetic
agccccgccuccgcgcguag

SEQ ID NO: 659 - RNA, 20 nt, Artificial Sequence
  Synthetic
agcgggacucggcggcaugg

SEQ ID NO: 660 - RNA, 20 nt, Artificial Sequence
  Synthetic
augccccuacgcgcggaggc

SEQ ID NO: 661 - RNA, 20 nt, Artificial Sequence
  Synthetic
auuuccggguccgggccgag

SEQ ID NO: 662 - RNA, 20 nt, Artificial Sequence
  Synthetic
cagccccgccuccgcgcgua

SEQ ID NO: 663 - RNA, 20 nt, Artificial Sequence
  Synthetic
cauguugauucgggccaaag

SEQ ID NO: 664 - RNA, 20 nt, Artificial Sequence
  Synthetic
cccggaaaugccccuacgcg

SEQ ID NO: 665 - RNA, 20 nt, Artificial Sequence
  Synthetic
ccgcgcguaggggcauuucc

SEQ ID NO: 666 - RNA, 20 nt, Artificial Sequence
  Synthetic
cgaaucaacauggaaaccua

SEQ ID NO: 667 - RNA, 20 nt, Artificial Sequence
  Synthetic
cgcggcggcaggaacuuucc

SEQ ID NO: 668 - RNA, 20 nt, Artificial Sequence
  Synthetic
cggcggcaggaacuuucccg

SEQ ID NO: 669 - RNA, 20 nt, Artificial Sequence
  Synthetic
cguaggggcauuuccggguc

SEQ ID NO: 670 - RNA, 20 nt, Artificial Sequence
  Synthetic
cucggcggcauggcgggcuc

SEQ ID NO: 671 - RNA, 20 nt, Artificial Sequence
  Synthetic
cucuuuggcccgaaucaaca

SEQ ID NO: 672 - RNA, 20 nt, Artificial Sequence
  Synthetic
uccgcgcguaggggcauuuc

SEQ ID NO: 673 - RNA, 20 nt, Artificial Sequence
  Synthetic
ugccccuacgcgcggaggcg

SEQ ID NO: 674 - RNA, 20 nt, Artificial Sequence
  Synthetic
uuuccggguccgggccgagc

SEQ ID NO: 675 - RNA, 22 nt, Artificial Sequence
  Synthetic
gccuccgcgcguaggggcauuu

SEQ ID NO: 676 - RNA, 22 nt, Artificial Sequence
  Synthetic
ggcuccggagcccgccaugccg

SEQ ID NO: 677 - RNA, 22 nt, Artificial Sequence
  Synthetic
ccaguaagcgcgccucuuuggc

SEQ ID NO: 678 - RNA, 22 nt, Artificial Sequence
  Synthetic
cuuacuggccaggccuucccgc

SEQ ID NO: 679 - RNA, 20 nt, Artificial Sequence
  Synthetic
gacgucaggugggaagggug

SEQ ID NO: 680 - RNA, 20 nt, Artificial Sequence
  Synthetic
gcagccaggcucgcgauggg

SEQ ID NO: 681 - RNA, 20 nt, Artificial Sequence
  Synthetic
gcaggcgcaggggagacccg

SEQ ID NO: 682 - RNA, 20 nt, Artificial Sequence
  Synthetic
gccaggcucgcgaugggagg

SEQ ID NO: 683 - RNA, 20 nt, Artificial Sequence
  Synthetic
gcccggugacugcaaggccc

SEQ ID NO: 684 - RNA, 20 nt, Artificial Sequence
  Synthetic
gcgcaggcgcaggggagacc

SEQ ID NO: 685 - RNA, 20 nt, Artificial Sequence
  Synthetic
gcgccugcgcggcgagcagc

SEQ ID NO: 686 - RNA, 20 nt, Artificial Sequence
  Synthetic
gcucgcgaugggaggugggg

SEQ ID NO: 687 - RNA, 20 nt, Artificial Sequence
  Synthetic
gcugcucgccgcgcaggcgc

SEQ ID NO: 688 - RNA, 20 nt, Artificial Sequence
  Synthetic
gcuucaggcuugacgucagg

SEQ ID NO: 689 - RNA, 20 nt, Artificial Sequence
  Synthetic
gcuugagcccggugacugca

SEQ ID NO: 690 - RNA, 20 nt, Artificial Sequence
  Synthetic
ggcgcagccaggcucgcgau

SEQ ID NO: 691 - RNA, 20 nt, Artificial Sequence
  Synthetic
ggcgccagcuuccggcuuag

SEQ ID NO: 692 - RNA, 20 nt, Artificial Sequence
  Synthetic
ggcucgcgaugggagguggg

SEQ ID NO: 693 - RNA, 20 nt, Artificial Sequence
  Synthetic
ggcuugacgucaggugggaa

SEQ ID NO: 694 - RNA, 20 nt, Artificial Sequence
  Synthetic
ggggcgguugggagguuggg

SEQ ID NO: 695 - RNA, 20 nt, Artificial Sequence
  Synthetic
gggucuccccugcgccugcg

SEQ ID NO: 696 - RNA, 20 nt, Artificial Sequence
  Synthetic
gguggcaggugggggcgguu

SEQ ID NO: 697 - RNA, 20 nt, Artificial Sequence
  Synthetic
gucaccgggcucaagcacgc

SEQ ID NO: 698 - RNA, 20 nt, Artificial Sequence
  Synthetic
gugggggcgguugggagguu

SEQ ID NO: 699 - RNA, 20 nt, Artificial Sequence
  Synthetic
acccggggccuugcagucac

SEQ ID NO: 700 - RNA, 20 nt, Artificial Sequence
  Synthetic
acgucaggugggaagggugu

SEQ ID NO: 701 - RNA, 20 nt, Artificial Sequence
  Synthetic
aggcuugacgucagguggga

SEQ ID NO: 702 - RNA, 20 nt, Artificial Sequence
  Synthetic
caggcucgcgaugggaggug

SEQ ID NO: 703 - RNA, 20 nt, Artificial Sequence
  Synthetic
caucgcgagccuggcugcgc

SEQ ID NO: 704 - RNA, 20 nt, Artificial Sequence
  Synthetic
caucuucuggcgccagcuuc

SEQ ID NO: 705 - RNA, 20 nt, Artificial Sequence
  Synthetic
ccaggcucgcgaugggaggu

SEQ ID NO: 706 - RNA, 20 nt, Artificial Sequence
  Synthetic
cccaccucccaucgcgagcc

SEQ ID NO: 707 - RNA, 20 nt, Artificial Sequence
  Synthetic
cccggggccuugcagucacc

SEQ ID NO: 708 - RNA, 20 nt, Artificial Sequence
  Synthetic
cccggugacugcaaggcccc

SEQ ID NO: 709 - RNA, 20 nt, Artificial Sequence
  Synthetic
cgcaggcgcaggggagaccc

SEQ ID NO: 710 - RNA, 20 nt, Artificial Sequence
  Synthetic
cggcgagcagcuggcggaac

SEQ ID NO: 711 - RNA, 20 nt, Artificial Sequence
  Synthetic
cggcgcagccaggcucgcga

SEQ ID NO: 712 - RNA, 20 nt, Artificial Sequence
  Synthetic
cggcuuagcggcugagcuuc

SEQ ID NO: 713 - RNA, 20 nt, Artificial Sequence
  Synthetic
cugaagcucagccgcuaagc

SEQ ID NO: 714 - RNA, 20 nt, Artificial Sequence
  Synthetic
cuggcggaaccggcaucuuc

SEQ ID NO: 715 - RNA, 20 nt, Artificial Sequence
  Synthetic
ucaagcacgccggcgcagcc

SEQ ID NO: 716 - RNA, 20 nt, Artificial Sequence
  Synthetic
ucagccgcuaagccggaagc

SEQ ID NO: 717 - RNA, 20 nt, Artificial Sequence
  Synthetic
ugagcuucaggcuugacguc

SEQ ID NO: 718 - RNA, 20 nt, Artificial Sequence
  Synthetic
ugcgccggcgugcuugagcc

SEQ ID NO: 719 - RNA, 22 nt, Artificial Sequence
  Synthetic
gguugggggggguugggguggg

SEQ ID NO: 720 - RNA, 22 nt, Artificial Sequence
  Synthetic
cgguugggagguuggggggggu

SEQ ID NO: 721 - RNA, 22 nt, Artificial Sequence
  Synthetic
ugagcccggugacugcaaggcc

SEQ ID NO: 722 - RNA, 22 nt, Artificial Sequence
  Synthetic
ugggggcgguugggagguuggg

SEQ ID NO: 723 - RNA, 22 nt, Artificial Sequence
  Synthetic
uucaggcuugacgucagguggg

SEQ ID NO: 724 - RNA, 22 nt, Artificial Sequence
  Synthetic
uugacgucaggugggaagggug

SEQ ID NO: 725 - RNA, 20 nt, Artificial Sequence
  Synthetic
gaaguagcugauacucucau

SEQ ID NO: 726 - RNA, 20 nt, Artificial Sequence
  Synthetic
gacaagcccaaccggacggc

SEQ ID NO: 727 - RNA, 20 nt, Artificial Sequence
  Synthetic
gacggcuggagagggcgaga

SEQ ID NO: 728 - RNA, 20 nt, Artificial Sequence
  Synthetic
gagagggcgagaagggcaga

SEQ ID NO: 729 - RNA, 20 nt, Artificial Sequence
  Synthetic
gagagguaggauccggaagu

SEQ ID NO: 730 - RNA, 20 nt, Artificial Sequence
  Synthetic
gaucacgucccgcaggccgg

SEQ ID NO: 731 - RNA, 20 nt, Artificial Sequence
  Synthetic
gaucuaaaucccgccuuuuc

SEQ ID NO: 732 - RNA, 20 nt, Artificial Sequence
  Synthetic
gcaccgccuaccaagacggg

SEQ ID NO: 733 - RNA, 20 nt, Artificial Sequence
  Synthetic
gcccaaccggacggcuggag

SEQ ID NO: 734 - RNA, 20 nt, Artificial Sequence
  Synthetic
gcccucuccagccguccggu

SEQ ID NO: 735 - RNA, 20 nt, Artificial Sequence
  Synthetic
gcgggcguuuuggaagauac

SEQ ID NO: 736 - RNA, 20 nt, Artificial Sequence
  Synthetic
ggagagguaggauccggaag

SEQ ID NO: 737 - RNA, 20 nt, Artificial Sequence
  Synthetic
ggauuuagaucacgucccgc

SEQ ID NO: 738 - RNA, 20 nt, Artificial Sequence
  Synthetic
ggcgguuaagacacuaggau

SEQ ID NO: 739 - RNA, 20 nt, Artificial Sequence
  Synthetic
ggugccgugacaagcccaac

SEQ ID NO: 740 - RNA, 20 nt, Artificial Sequence
  Synthetic
acgcccgcuuucacagauca

SEQ ID NO: 741 - RNA, 20 nt, Artificial Sequence
  Synthetic
acggcaccgccuaccaagac

SEQ ID NO: 742 - RNA, 20 nt, Artificial Sequence
  Synthetic
agacgggcgguuaagacacu

SEQ ID NO: 743 - RNA, 20 nt, Artificial Sequence
  Synthetic
agaguaucagcuacuuccgc

SEQ ID NO: 744 - RNA, 20 nt, Artificial Sequence
  Synthetic
agauaccggaaguagaguca

SEQ ID NO: 745 - RNA, 20 nt, Artificial Sequence
  Synthetic
agcuacuuccgccggccugc

SEQ ID NO: 746 - RNA, 20 nt, Artificial Sequence
  Synthetic
agucacggagagguaggauc

SEQ ID NO: 747 - RNA, 20 nt, Artificial Sequence
  Synthetic
agugucuuaaccgcccgucu

SEQ ID NO: 748 - RNA, 20 nt, Artificial Sequence
  Synthetic
aucugugaaagcgggcguuu

SEQ ID NO: 749 - RNA, 20 nt, Artificial Sequence
  Synthetic
cacggcaccgccuaccaaga

SEQ ID NO: 750 - RNA, 20 nt, Artificial Sequence
  Synthetic
cccaaccggacggcuggaga

SEQ ID NO: 751 - RNA, 20 nt, Artificial Sequence
  Synthetic
cccucuccagccguccgguu

SEQ ID NO: 752 - RNA, 20 nt, Artificial Sequence
  Synthetic
ccggaaguagagucacggag

SEQ ID NO: 753 - RNA, 20 nt, Artificial Sequence
  Synthetic
ccguccgguugggcuuguca

SEQ ID NO: 754 - RNA, 20 nt, Artificial Sequence
  Synthetic
ccgugacaagcccaaccgga

SEQ ID NO: 755 - RNA, 20 nt, Artificial Sequence
  Synthetic
cuaaaucccgccuuuuccgg

SEQ ID NO: 756 - RNA, 20 nt, Artificial Sequence
  Synthetic
uaaccgcccgucuugguagg

SEQ ID NO: 757 - RNA, 20 nt, Artificial Sequence
  Synthetic
ucccgccuuuuccgguggag

SEQ ID NO: 758 - RNA, 20 nt, Artificial Sequence
  Synthetic
ucuuaaccgcccgucuuggu

SEQ ID NO: 759 - RNA, 20 nt, Artificial Sequence
  Synthetic
uuagaucacgucccgcaggc

SEQ ID NO: 760 - RNA, 22 nt, Artificial Sequence
  Synthetic
gcguuuuggaagauaccggaag

SEQ ID NO: 761 - RNA, 22 nt, Artificial Sequence
  Synthetic
ggcuccucuccaccggaaaagg

SEQ ID NO: 762 - RNA, 22 nt, Artificial Sequence
  Synthetic
agaucaagguuuugcaaccaau

SEQ ID NO: 763 - RNA, 22 nt, Artificial Sequence
  Synthetic
auuuaaagaggcagccccacuu

SEQ ID NO: 764 - RNA, 22 nt, Artificial Sequence
  Synthetic
ccaagacgggcgguuaagacac

SEQ ID NO: 765 - RNA, 22 nt, Artificial Sequence
  Synthetic
cggaaguagagucacggagagg

SEQ ID NO: 766 - RNA, 20 nt, Artificial Sequence
  Synthetic
gcaguccgcuggcugcugcc

SEQ ID NO: 767 - RNA, 20 nt, Artificial Sequence
  Synthetic
gccagcggacugcgcacgcg

SEQ ID NO: 768 - RNA, 20 nt, Artificial Sequence
  Synthetic
gcccgcucgcgcaaaccgaa

SEQ ID NO: 769 - RNA, 20 nt, Artificial Sequence
  Synthetic
gccuuucgguuugcgcgagc

SEQ ID NO: 770 - RNA, 20 nt, Artificial Sequence
  Synthetic
gcgacgaagccgcugguggc

SEQ ID NO: 771 - RNA, 20 nt, Artificial Sequence
  Synthetic
gcgauuccaccuaccgucag

SEQ ID NO: 772 - RNA, 20 nt, Artificial Sequence
  Synthetic
gcgcucccuccagggagaaa

SEQ ID NO: 773 - RNA, 20 nt, Artificial Sequence
  Synthetic
gcggcuucgucgcaccaaac

SEQ ID NO: 774 - RNA, 20 nt, Artificial Sequence
  Synthetic
gcgucugagcagccccucgc

SEQ ID NO: 775 - RNA, 20 nt, Artificial Sequence
  Synthetic
gcucgagugaagguacucgu

SEQ ID NO: 776 - RNA, 20 nt, Artificial Sequence
  Synthetic
gcugcccggcguggauggua

SEQ ID NO: 777 - RNA, 20 nt, Artificial Sequence
  Synthetic
gcugcucagacgcugcgggu

SEQ ID NO: 778 - RNA, 20 nt, Artificial Sequence
  Synthetic
ggccuaugccuggcgugggc

SEQ ID NO: 779 - RNA, 20 nt, Artificial Sequence
  Synthetic
ggccuuucgguuugcgcgag

SEQ ID NO: 780 - RNA, 20 nt, Artificial Sequence
  Synthetic
ggcgcucucgcggccgcuga

SEQ ID NO: 781 - RNA, 20 nt, Artificial Sequence
  Synthetic
ggucuugggauacaggggcg

SEQ ID NO: 782 - RNA, 20 nt, Artificial Sequence
  Synthetic
gguggaaucgcguucgaguc

SEQ ID NO: 783 - RNA, 20 nt, Artificial Sequence
  Synthetic
gugcgugcggcuaagagagu

SEQ ID NO: 784 - RNA, 20 nt, Artificial Sequence
  Synthetic
guggaaucgcguucgagucc

SEQ ID NO: 785 - RNA, 20 nt, Artificial Sequence
  Synthetic
guuuggugcgacgaagccgc

SEQ ID NO: 786 - RNA, 20 nt, Artificial Sequence
  Synthetic
aaucgcguucgaguccgggc

SEQ ID NO: 787 - RNA, 20 nt, Artificial Sequence
  Synthetic
acccugccuccucuugcggu

SEQ ID NO: 788 - RNA, 20 nt, Artificial Sequence
  Synthetic
accgaaaggccuagaguaag

SEQ ID NO: 789 - RNA, 20 nt, Artificial Sequence
  Synthetic
cagacgcugcggguuggccc

SEQ ID NO: 790 - RNA, 20 nt, Artificial Sequence
  Synthetic
cgagcccuaccauccacgcc

SEQ ID NO: 791 - RNA, 20 nt, Artificial Sequence
  Synthetic
cgcuggccuuuucucccugg

SEQ ID NO: 792 - RNA, 20 nt, Artificial Sequence
  Synthetic
cgcuuuccccccaccgcaag

SEQ ID NO: 793 - RNA, 20 nt, Artificial Sequence
  Synthetic
cgggcaggaaagcgugcgug

SEQ ID NO: 794 - RNA, 20 nt, Artificial Sequence
  Synthetic
cgugcgugcggcuaagagag

SEQ ID NO: 795 - RNA, 20 nt, Artificial Sequence
  Synthetic
cuccacuuacccuggccacu

SEQ ID NO: 796 - RNA, 20 nt, Artificial Sequence
  Synthetic
cugccuccucuugcgguggg

SEQ ID NO: 797 - RNA, 20 nt, Artificial Sequence
  Synthetic
cugcggguuggcccuggcgc

SEQ ID NO: 798 - RNA, 20 nt, Artificial Sequence
  Synthetic
uaagagagugggcgcucucg

SEQ ID NO: 799 - RNA, 20 nt, Artificial Sequence
  Synthetic
ucgagcccuaccauccacgc

SEQ ID NO: 800 - RNA, 20 nt, Artificial Sequence
  Synthetic
ucgcggccgcugacgguagg

SEQ ID NO: 801 - RNA, 20 nt, Artificial Sequence
  Synthetic
ugcugcccggcguggauggu

SEQ ID NO: 802 - RNA, 20 nt, Artificial Sequence
  Synthetic
uggagggagcgcgcgcugcc

SEQ ID NO: 803 - RNA, 20 nt, Artificial Sequence
  Synthetic
uggugcgacgaagccgcugg

SEQ ID NO: 804 - RNA, 20 nt, Artificial Sequence
  Synthetic
uucgguuugcgcgagcgggc

SEQ ID NO: 805 - RNA, 20 nt, Artificial Sequence
  Synthetic
uuuccccccaccgcaagagg

SEQ ID NO: 806 - RNA, 22 nt, Artificial Sequence
  Synthetic
guccagggcaggccuccggggg

SEQ ID NO: 807 - RNA, 22 nt, Artificial Sequence
  Synthetic
accgcaagaggaggcagggucu

SEQ ID NO: 808 - RNA, 22 nt, Artificial Sequence
  Synthetic
agcgaggggcugcucagacgcu

SEQ ID NO: 809 - RNA, 22 nt, Artificial Sequence
  Synthetic
aggaaagcgugcgugcggcuaa

SEQ ID NO: 810 - RNA, 22 nt, Artificial Sequence
  Synthetic
aguccgcuggcugcugcccggc

SEQ ID NO: 811 - RNA, 22 nt, Artificial Sequence
  Synthetic
augagaggagcgccccaguggc

SEQ ID NO: 812 - RNA, 22 nt, Artificial Sequence
  Synthetic
cccuggagggagcgcgcgcugc

SEQ ID NO: 813 - RNA, 22 nt, Artificial Sequence
  Synthetic
cgcucgcgcaaaccgaaaggcc

SEQ ID NO: 814 - RNA, 22 nt, Artificial Sequence
  Synthetic
cgucgcaccaaacaggcgacca

SEQ ID NO: 815 - RNA, 22 nt, Artificial Sequence
  Synthetic
cugacgguagguggaaucgcgu

SEQ ID NO: 816 - RNA, 22 nt, Artificial Sequence
  Synthetic
ucucgcggccgcugacgguagg

SEQ ID NO: 817 - RNA, 22 nt, Artificial Sequence
  Synthetic
ugcccggcguggaugguagggc

SEQ ID NO: 818 - RNA, 22 nt, Artificial Sequence
  Synthetic
uuccccccaccgcaagaggagg

SEQ ID NO: 819 - RNA, 20 nt, Artificial Sequence
  Synthetic
gaguucuuucgaggggcaga

SEQ ID NO: 820 - RNA, 20 nt, Artificial Sequence
  Synthetic
gccgcgcgcugccucgccau

SEQ ID NO: 821 - RNA, 20 nt, Artificial Sequence
  Synthetic
gcgccgccgaucccagaguc

SEQ ID NO: 822 - RNA, 20 nt, Artificial Sequence
  Synthetic
gcgcggcuucccggaagugg

SEQ ID NO: 823 - RNA, 20 nt, Artificial Sequence
  Synthetic
gcgcuaugaguucuuucgag

SEQ ID NO: 824 - RNA, 20 nt, Artificial Sequence
  Synthetic
gcgggcgccuagaacccgac

SEQ ID NO: 825 - RNA, 20 nt, Artificial Sequence
  Synthetic
gcuucccggaaguggcggcg

SEQ ID NO: 826 - RNA, 20 nt, Artificial Sequence
  Synthetic
gcuucgauagggagaaccug

SEQ ID NO: 827 - RNA, 20 nt, Artificial Sequence
  Synthetic
ggaaguaggcgcgggcccuc

SEQ ID NO: 828 - RNA, 20 nt, Artificial Sequence
  Synthetic
ggagaccgggggcaaaguca

SEQ ID NO: 829 - RNA, 20 nt, Artificial Sequence
  Synthetic
ggagcauccggucggguucu

SEQ ID NO: 830 - RNA, 20 nt, Artificial Sequence
  Synthetic
ggcgcggucagggcuggccu

SEQ ID NO: 831 - RNA, 20 nt, Artificial Sequence
  Synthetic
ggcgcuaugaguucuuucga

SEQ ID NO: 832 - RNA, 20 nt, Artificial Sequence
  Synthetic
ggcugcguucggccgcccaa

SEQ ID NO: 833 - RNA, 20 nt, Artificial Sequence
  Synthetic
gggcaaagucaaggagcauc

SEQ ID NO: 834 - RNA, 20 nt, Artificial Sequence
  Synthetic
ggggucccggacucugggau

SEQ ID NO: 835 - RNA, 20 nt, Artificial Sequence
  Synthetic
ggucuccggacuccucugau

SEQ ID NO: 836 - RNA, 20 nt, Artificial Sequence
  Synthetic
gguuuuggggucccggacuc

SEQ ID NO: 837 - RNA, 20 nt, Artificial Sequence
  Synthetic
gucccggacucugggaucgg

SEQ ID NO: 838 - RNA, 20 nt, Artificial Sequence
  Synthetic
guuuuggggucccggacucu

SEQ ID NO: 839 - RNA, 20 nt, Artificial Sequence
  Synthetic
aagcggucuauggagauagu

SEQ ID NO: 840 - RNA, 20 nt, Artificial Sequence
  Synthetic
acgcagccacguccaaucag

SEQ ID NO: 841 - RNA, 20 nt, Artificial Sequence
  Synthetic
agcgcgcggcuucccggaag

SEQ ID NO: 842 - RNA, 20 nt, Artificial Sequence
  Synthetic
aucagaggaguccggagacc

SEQ ID NO: 843 - RNA, 20 nt, Artificial Sequence
  Synthetic
cacguccaaucagaggaguc

SEQ ID NO: 844 - RNA, 20 nt, Artificial Sequence
  Synthetic
cccaauggcgaggcagcgcg

SEQ ID NO: 845 - RNA, 20 nt, Artificial Sequence
  Synthetic
ccgcgcgcugccucgccauu

SEQ ID NO: 846 - RNA, 20 nt, Artificial Sequence
  Synthetic
ccugaccgcgccgccacuuc

SEQ ID NO: 847 - RNA, 20 nt, Artificial Sequence
  Synthetic
cgccgccgaucccagagucc

SEQ ID NO: 848 - RNA, 20 nt, Artificial Sequence
  Synthetic
cggaaguggcggcgcgguca

SEQ ID NO: 849 - RNA, 20 nt, Artificial Sequence
  Synthetic
cggacuccucugauuggacg

SEQ ID NO: 850 - RNA, 20 nt, Artificial Sequence
  Synthetic
cggcgcuaugaguucuuucg

SEQ ID NO: 851 - RNA, 20 nt, Artificial Sequence
  Synthetic
cguucggccgcccaauggcg

SEQ ID NO: 852 - RNA, 20 nt, Artificial Sequence
  Synthetic
cuccauagaccgcuucgaua

SEQ ID NO: 853 - RNA, 20 nt, Artificial Sequence
  Synthetic
cucccuaucgaagcggucua

SEQ ID NO: 854 - RNA, 20 nt, Artificial Sequence
  Synthetic
cugaccgcgccgccacuucc

SEQ ID NO: 855 - RNA, 20 nt, Artificial Sequence
  Synthetic
cuucgauagggagaaccuga

SEQ ID NO: 856 - RNA, 20 nt, Artificial Sequence
  Synthetic
ucagaggaguccggagaccg

SEQ ID NO: 857 - RNA, 20 nt, Artificial Sequence
  Synthetic
ucuccauagaccgcuucgau

SEQ ID NO: 858 - RNA, 20 nt, Artificial Sequence
  Synthetic
ugauuggacguggcugcguu

SEQ ID NO: 859 - RNA, 22 nt, Artificial Sequence
  Synthetic
gaacgcagccacguccaaucag

SEQ ID NO: 860 - RNA, 22 nt, Artificial Sequence
  Synthetic
gaacucauagcgccgccgaucc

SEQ ID NO: 861 - RNA, 22 nt, Artificial Sequence
  Synthetic
gcagcgggcgccuagaacccga

SEQ ID NO: 862 - RNA, 22 nt, Artificial Sequence
  Synthetic
gccuuggcuucagcugcgguuu

SEQ ID NO: 863 - RNA, 22 nt, Artificial Sequence
  Synthetic
gcgguuuuggggucccggacuc

SEQ ID NO: 864 - RNA, 22 nt, Artificial Sequence
  Synthetic
ggacucugggaucggcggcgcu

SEQ ID NO: 865 - RNA, 22 nt, Artificial Sequence
  Synthetic
ggcaaagucaaggagcauccgg

SEQ ID NO: 866 - RNA, 22 nt, Artificial Sequence
  Synthetic
aguucuuucgaggggcagaugg

SEQ ID NO: 867 - RNA, 22 nt, Artificial Sequence
  Synthetic
ucgaagcggucuauggagauag

SEQ ID NO: 868 - RNA, 20 nt, Artificial Sequence
  Synthetic
gacgguugggaugccugaca

SEQ ID NO: 869 - RNA, 20 nt, Artificial Sequence
  Synthetic
gaggcgcagcagugccacag

SEQ ID NO: 870 - RNA, 20 nt, Artificial Sequence
  Synthetic
gcccacccaggccugacuuc

SEQ ID NO: 871 - RNA, 20 nt, Artificial Sequence
  Synthetic
gccucgggugucuuuugcgg

SEQ ID NO: 872 - RNA, 20 nt, Artificial Sequence
  Synthetic
gcgaaaggaaauuccuuguc

SEQ ID NO: 873 - RNA, 20 nt, Artificial Sequence
  Synthetic
gcugcgccucugcugcgccu

SEQ ID NO: 874 - RNA, 20 nt, Artificial Sequence
  Synthetic
gcugcggguauuucucagug

SEQ ID NO: 875 - RNA, 20 nt, Artificial Sequence
  Synthetic
guauuucucaguguggcgaa

SEQ ID NO: 876 - RNA, 20 nt, Artificial Sequence
  Synthetic
gugugcugcgugucgcguca

SEQ ID NO: 877 - RNA, 20 nt, Artificial Sequence
  Synthetic
acacgcaccacccggaaguc

SEQ ID NO: 878 - RNA, 20 nt, Artificial Sequence
  Synthetic
acacugagaaauacccgcag

SEQ ID NO: 879 - RNA, 20 nt, Artificial Sequence
  Synthetic
accacccggaagucaggccu

SEQ ID NO: 880 - RNA, 20 nt, Artificial Sequence
  Synthetic
acccaggccugacuuccggg

SEQ ID NO: 881 - RNA, 20 nt, Artificial Sequence
  Synthetic
accgccgcaaaagacacccg

SEQ ID NO: 882 - RNA, 20 nt, Artificial Sequence
  Synthetic
acggcgucacguggccagcg

SEQ ID NO: 883 - RNA, 20 nt, Artificial Sequence
  Synthetic
acguggccagcgcgggcuug

SEQ ID NO: 884 - RNA, 20 nt, Artificial Sequence
  Synthetic
auacccgcagcggcccaccc

SEQ ID NO: 885 - RNA, 20 nt, Artificial Sequence
  Synthetic
caccacccggaagucaggcc

SEQ ID NO: 886 - RNA, 20 nt, Artificial Sequence
  Synthetic
cccggaagucaggccugggu

SEQ ID NO: 887 - RNA, 20 nt, Artificial Sequence
  Synthetic
cgcgagcuucugaaacuagg

SEQ ID NO: 888 - RNA, 20 nt, Artificial Sequence
  Synthetic
cggcagaggcggagccgcug

SEQ ID NO: 889 - RNA, 20 nt, Artificial Sequence
  Synthetic
cggcgucacguggccagcgc

SEQ ID NO: 890 - RNA, 20 nt, Artificial Sequence
  Synthetic
cgggugucuuuugcggcggu

SEQ ID NO: 891 - RNA, 20 nt, Artificial Sequence
  Synthetic
cucgcgccacaagcccgcgc

SEQ ID NO: 892 - RNA, 20 nt, Artificial Sequence
  Synthetic
cuucugaaacuaggcggcag

SEQ ID NO: 893 - RNA, 20 nt, Artificial Sequence
  Synthetic
ucgggugucuuuugcggcgg

SEQ ID NO: 894 - RNA, 20 nt, Artificial Sequence
  Synthetic
ugcgccucgggugucuuuug

SEQ ID NO: 895 - RNA, 20 nt, Artificial Sequence
  Synthetic
uggcgcgagcuucugaaacu

SEQ ID NO: 896 - RNA, 20 nt, Artificial Sequence
  Synthetic
ugucgcgucacggcgucacg

SEQ ID NO: 897 - RNA, 22 nt, Artificial Sequence
  Synthetic
gccucgggugucuuuugcggcg

SEQ ID NO: 898 - RNA, 22 nt, Artificial Sequence
  Synthetic
gcggcccacccaggccugacuu

SEQ ID NO: 899 - RNA, 22 nt, Artificial Sequence
  Synthetic
acgcaccacccggaagucaggc

SEQ ID NO: 900 - RNA, 22 nt, Artificial Sequence
  Synthetic
acugcugcgccucugcugcgcc

SEQ ID NO: 901 - RNA, 22 nt, Artificial Sequence
  Synthetic
agucaggccugggugggccgcu

SEQ ID NO: 902 - RNA, 22 nt, Artificial Sequence
  Synthetic
cugacgguugggaugccugaca

SEQ ID NO: 903 - RNA, 20 nt, Artificial Sequence
  Synthetic
gaagcgccgcacucuccuua

SEQ ID NO: 904 - RNA, 20 nt, Artificial Sequence
  Synthetic
gaaggcggauccgggaggcg

SEQ ID NO: 905 - RNA, 20 nt, Artificial Sequence
  Synthetic
gagaaggcggauccgggagg

SEQ ID NO: 906 - RNA, 20 nt, Artificial Sequence
  Synthetic
gcagggcggaagcggggaga

SEQ ID NO: 907 - RNA, 20 nt, Artificial Sequence
  Synthetic
gccgcacucuccuuagggcu

SEQ ID NO: 908 - RNA, 20 nt, Artificial Sequence
  Synthetic
gcgggaauucugaaagccgc

SEQ ID NO: 909 - RNA, 20 nt, Artificial Sequence
  Synthetic
gcugggaacugcaacucauc

SEQ ID NO: 910 - RNA, 20 nt, Artificial Sequence
  Synthetic
gcuucccgaggcgugcagcu

SEQ ID NO: 911 - RNA, 20 nt, Artificial Sequence
  Synthetic
ggaagcgccgcacucuccuu

SEQ ID NO: 912 - RNA, 20 nt, Artificial Sequence
  Synthetic
ggaauucugaaagccgcugg

SEQ ID NO: 913 - RNA, 20 nt, Artificial Sequence
  Synthetic
ggagagugcggcgcuucccg

SEQ ID NO: 914 - RNA, 20 nt, Artificial Sequence
  Synthetic
ggcagucuguaaacucgcgc

SEQ ID NO: 915 - RNA, 20 nt, Artificial Sequence
  Synthetic
gggauacguuacgucgacgc

SEQ ID NO: 916 - RNA, 20 nt, Artificial Sequence
  Synthetic
gggcggaagcggggagaagg

SEQ ID NO: 917 - RNA, 20 nt, Artificial Sequence
  Synthetic
gggcgugacccugggcgaga

SEQ ID NO: 918 - RNA, 20 nt, Artificial Sequence
  Synthetic
ggggagaaggcggauccggg

SEQ ID NO: 919 - RNA, 20 nt, Artificial Sequence
  Synthetic
ggggauacguuacgucgacg

SEQ ID NO: 920 - RNA, 20 nt, Artificial Sequence
  Synthetic
gucgacgcgggcgugacccu

SEQ ID NO: 921 - RNA, 20 nt, Artificial Sequence
  Synthetic
guuagcgcgcagggcggaag

SEQ ID NO: 922 - RNA, 20 nt, Artificial Sequence
  Synthetic
aagcggggagaaggcggauc

SEQ ID NO: 923 - RNA, 20 nt, Artificial Sequence
  Synthetic
aagcucucgagcucccgucu

SEQ ID NO: 924 - RNA, 20 nt, Artificial Sequence
  Synthetic
agcucucgagcucccgucuu

SEQ ID NO: 925 - RNA, 20 nt, Artificial Sequence
  Synthetic
aguucccagcugcacgccuc

SEQ ID NO: 926 - RNA, 20 nt, Artificial Sequence
  Synthetic
cccgucuuggguuagcgcgc

SEQ ID NO: 927 - RNA, 20 nt, Artificial Sequence
  Synthetic
cccugcgcgcuaacccaaga

SEQ ID NO: 928 - RNA, 20 nt, Artificial Sequence
  Synthetic
ccgccaaacccucucgccca

SEQ ID NO: 929 - RNA, 20 nt, Artificial Sequence
  Synthetic
ccgucuuggguuagcgcgca

SEQ ID NO: 930 - RNA, 20 nt, Artificial Sequence
  Synthetic
ccugcgcgcuaacccaagac

SEQ ID NO: 931 - RNA, 20 nt, Artificial Sequence
  Synthetic
cgcugcgcgcgguccgccag

SEQ ID NO: 932 - RNA, 20 nt, Artificial Sequence
  Synthetic
cgcuggcggaccgcgcgcag

SEQ ID NO: 933 - RNA, 20 nt, Artificial Sequence
  Synthetic
cgggcgugacccugggcgag

SEQ ID NO: 934 - RNA, 20 nt, Artificial Sequence
  Synthetic
cggucucuggccgcugcgcg

SEQ ID NO: 935 - RNA, 20 nt, Artificial Sequence
  Synthetic
cguaacguauccccgccucc

SEQ ID NO: 936 - RNA, 20 nt, Artificial Sequence
  Synthetic
cgucgacgcgggcgugaccc

SEQ ID NO: 937 - RNA, 20 nt, Artificial Sequence
  Synthetic
uagcgcgcagggcggaagcg

SEQ ID NO: 938 - RNA, 20 nt, Artificial Sequence
  Synthetic
ucaucuggguugugcgcaga

SEQ ID NO: 939 - RNA, 20 nt, Artificial Sequence
  Synthetic
ucuuggguuagcgcgcaggg

SEQ ID NO: 940 - RNA, 20 nt, Artificial Sequence
  Synthetic
uggguugugcgcagaaggcu

SEQ ID NO: 941 - RNA, 20 nt, Artificial Sequence
  Synthetic
uuagcgcgcagggcggaagc

SEQ ID NO: 942 - RNA, 22 nt, Artificial Sequence
  Synthetic
gagcucgagagcuugauccugc

SEQ ID NO: 943 - RNA, 22 nt, Artificial Sequence
  Synthetic
gagggcagucuguaaacucgcg

SEQ ID NO: 944 - RNA, 22 nt, Artificial Sequence
  Synthetic
gcagcugggaacugcaacucau

SEQ ID NO: 945 - RNA, 22 nt, Artificial Sequence
  Synthetic
gcagggcggaagcggggagaag

SEQ ID NO: 946 - RNA, 22 nt, Artificial Sequence
  Synthetic
ggagaaggcggauccgggaggc

SEQ ID NO: 947 - RNA, 22 nt, Artificial Sequence
  Synthetic
acccugggcgagaggguuuggc

SEQ ID NO: 948 - RNA, 22 nt, Artificial Sequence
  Synthetic
acgcgggcgugacccugggcga

SEQ ID NO: 949 - RNA, 22 nt, Artificial Sequence
  Synthetic
aucaagcucucgagcucccguc

SEQ ID NO: 950 - RNA, 22 nt, Artificial Sequence
  Synthetic
auucccgccaaacccucucgcc

SEQ ID NO: 951 - RNA, 22 nt, Artificial Sequence
  Synthetic
cagccuucugcgcacaacccag

SEQ ID NO: 952 - RNA, 22 nt, Artificial Sequence
  Synthetic
cgacguaacguauccccgccuc

SEQ ID NO: 953 - RNA, 22 nt, Artificial Sequence
  Synthetic
cgcgcgguccgccagcggcuuu

SEQ ID NO: 954 - RNA, 22 nt, Artificial Sequence
  Synthetic
cggccagagaccgagcccuaag

SEQ ID NO: 955 - RNA, 20 nt, Artificial Sequence
  Synthetic
gaaggaugagguagaguaug

SEQ ID NO: 956 - RNA, 20 nt, Artificial Sequence
  Synthetic
gacauggggugagagggcgg

SEQ ID NO: 957 - RNA, 20 nt, Artificial Sequence
  Synthetic
gacgccggcgccggcgcgcc

SEQ ID NO: 958 - RNA, 20 nt, Artificial Sequence
  Synthetic
gacguccgaacccugcuuuc

SEQ ID NO: 959 - RNA, 20 nt, Artificial Sequence
  Synthetic
gagguagaguaugggguccg

SEQ ID NO: 960 - RNA, 20 nt, Artificial Sequence
  Synthetic
gaguaugggguccgaggggc

SEQ ID NO: 961 - RNA, 20 nt, Artificial Sequence
  Synthetic
gcgcucuucccgcucuggag

SEQ ID NO: 962 - RNA, 20 nt, Artificial Sequence
  Synthetic
gcgggguuguguguggcgga

SEQ ID NO: 963 - RNA, 20 nt, Artificial Sequence
  Synthetic
ggaggaaacgcucguugcua

SEQ ID NO: 964 - RNA, 20 nt, Artificial Sequence
  Synthetic
ggcuagagcgggguugugug

SEQ ID NO: 965 - RNA, 20 nt, Artificial Sequence
  Synthetic
ggcucccagaaagcaggguu

SEQ ID NO: 966 - RNA, 20 nt, Artificial Sequence
  Synthetic
ggcucgggccuuucaaaccc

SEQ ID NO: 967 - RNA, 20 nt, Artificial Sequence
  Synthetic
ggcuugcgcagugucgacgc

SEQ ID NO: 968 - RNA, 20 nt, Artificial Sequence
  Synthetic
gggcggggugcgcccugcgc

SEQ ID NO: 969 - RNA, 20 nt, Artificial Sequence
  Synthetic
ggguuguguguggcggaggg

SEQ ID NO: 970 - RNA, 20 nt, Artificial Sequence
  Synthetic
gguagaguaugggguccgag

SEQ ID NO: 971 - RNA, 20 nt, Artificial Sequence
  Synthetic
gguccgaggggcagggagag

SEQ ID NO: 972 - RNA, 20 nt, Artificial Sequence
  Synthetic
guccgaggggcagggagagu

SEQ ID NO: 973 - RNA, 20 nt, Artificial Sequence
  Synthetic
gugcgcaagcgcgcgaggcu

SEQ ID NO: 974 - RNA, 20 nt, Artificial Sequence
  Synthetic
gugggcuucgccuggccaga

SEQ ID NO: 975 - RNA, 20 nt, Artificial Sequence
  Synthetic
aagcaggguucggacgucau

SEQ ID NO: 976 - RNA, 20 nt, Artificial Sequence
  Synthetic
acauggcggaggcggaucuc

SEQ ID NO: 977 - RNA, 20 nt, Artificial Sequence
  Synthetic
acgcagcgcucuucccgcuc

SEQ ID NO: 978 - RNA, 20 nt, Artificial Sequence
  Synthetic
acguccgaacccugcuuucu

SEQ ID NO: 979 - RNA, 20 nt, Artificial Sequence
  Synthetic
acuccaucgugcaaugagaa

SEQ ID NO: 980 - RNA, 20 nt, Artificial Sequence
  Synthetic
agcaggguucggacgucauu

SEQ ID NO: 981 - RNA, 20 nt, Artificial Sequence
  Synthetic
aggguucggacgucauuggg

SEQ ID NO: 982 - RNA, 20 nt, Artificial Sequence
  Synthetic
cagucgcgccucuccagagc

SEQ ID NO: 983 - RNA, 20 nt, Artificial Sequence
  Synthetic
ccgcucuggagaggcgcgac

SEQ ID NO: 984 - RNA, 20 nt, Artificial Sequence
  Synthetic
ccggcgcgccgggguuugaa

SEQ ID NO: 985 - RNA, 20 nt, Artificial Sequence
  Synthetic
ccuuucaaaccccggcgcgc

SEQ ID NO: 986 - RNA, 20 nt, Artificial Sequence
  Synthetic
cgaccuccgggauugguguc

SEQ ID NO: 987 - RNA, 20 nt, Artificial Sequence
  Synthetic
cgcucuggagaggcgcgacu

SEQ ID NO: 988 - RNA, 20 nt, Artificial Sequence
  Synthetic
cuccggcaugucaacgucgu

SEQ ID NO: 989 - RNA, 20 nt, Artificial Sequence
  Synthetic
ucaacgucgugggcuucgcc

SEQ ID NO: 990 - RNA, 20 nt, Artificial Sequence
  Synthetic
ucggacgucauugggaggcg

SEQ ID NO: 991 - RNA, 20 nt, Artificial Sequence
  Synthetic
ucuccggcaugucaacgucg

SEQ ID NO: 992 - RNA, 20 nt, Artificial Sequence
  Synthetic
ugcgcaagcgcgcgaggcuc

SEQ ID NO: 993 - RNA, 20 nt, Artificial Sequence
  Synthetic
ugcgcacuuuagccagcgca

SEQ ID NO: 994 - RNA, 20 nt, Artificial Sequence
  Synthetic
uugcgcacuuuagccagcgc

SEQ ID NO: 995 - RNA, 22 nt, Artificial Sequence
  Synthetic
gacagggucuugcucucucacc

SEQ ID NO: 996 - RNA, 22 nt, Artificial Sequence
  Synthetic
gaucgugccacugcacuccauc

SEQ ID NO: 997 - RNA, 22 nt, Artificial Sequence
  Synthetic
gccagaaggaugagguagagua

SEQ ID NO: 998 - RNA, 22 nt, Artificial Sequence
  Synthetic
gccuagcaacagaagcgaccuc

SEQ ID NO: 999 - RNA, 22 nt, Artificial Sequence
  Synthetic
gcuacuuaggaggcugaagugg

SEQ ID NO: 1000 - RNA, 22 nt, Artificial Sequence
  Synthetic
ggaucccuuggccccaggagac

SEQ ID NO: 1001 - RNA, 22 nt, Artificial Sequence
  Synthetic
gggcagggagagugggaggggg

SEQ ID NO: 1002 - RNA, 22 nt, Artificial Sequence
  Synthetic
ggucuugcucucucacccagga

SEQ ID NO: 1003 - RNA, 22 nt, Artificial Sequence
  Synthetic
gucgacgccggcgccggcgcgc

SEQ ID NO: 1004 - RNA, 22 nt, Artificial Sequence
  Synthetic
gucgugggcuucgccuggccag

SEQ ID NO: 1005 - RNA, 22 nt, Artificial Sequence
  Synthetic
acuccaucgugcaaugagaaag

SEQ ID NO: 1006 - RNA, 22 nt, Artificial Sequence
  Synthetic
aguaugggguccgaggggcagg

SEQ ID NO: 1007 - RNA, 22 nt, Artificial Sequence
  Synthetic
auucgccuuucucauugcacga

SEQ ID NO: 1008 - RNA, 22 nt, Artificial Sequence
  Synthetic
caaccccugucuccuggggcca

SEQ ID NO: 1009 - RNA, 22 nt, Artificial Sequence
  Synthetic
ccacaaaaaauacaaaaauuag

SEQ ID NO: 1010 - RNA, 22 nt, Artificial Sequence
  Synthetic
ccacuucagccuccuaaguagc

SEQ ID NO: 1011 - RNA, 22 nt, Artificial Sequence
  Synthetic
cuguugcuaggcucccagaaag

SEQ ID NO: 1012 - RNA, 22 nt, Artificial Sequence
  Synthetic
ucauugggaggcgaggcuagag

SEQ ID NO: 1013 - RNA, 22 nt, Artificial Sequence
  Synthetic
ucgccuggccagaaggaugagg

SEQ ID NO: 1014 - RNA, 22 nt, Artificial Sequence
  Synthetic
uuuuaaaaauuuuuuguugaga

SEQ ID NO: 1015 - RNA, 22 nt, Artificial Sequence
  Synthetic
uuuuguauuuuuuguggagaca

SEQ ID NO: 1016 - RNA, 20 nt, Artificial Sequence
  Synthetic
gacgucugcgggcgggggcg

SEQ ID NO: 1017 - RNA, 20 nt, Artificial Sequence
  Synthetic
gacugcagaggcgcgccugg

SEQ ID NO: 1018 - RNA, 20 nt, Artificial Sequence
  Synthetic
gcaacacacucagauccgcc

SEQ ID NO: 1019 - RNA, 20 nt, Artificial Sequence
  Synthetic
gcagucccaaguucgcgcca

SEQ ID NO: 1020 - RNA, 20 nt, Artificial Sequence
  Synthetic
gcccgcgcuuucccucgccc

SEQ ID NO: 1021 - RNA, 20 nt, Artificial Sequence
  Synthetic
gccgucgcgcggaggacacu

SEQ ID NO: 1022 - RNA, 20 nt, Artificial Sequence
  Synthetic
gccuaugcuucgccaugucg

SEQ ID NO: 1023 - RNA, 20 nt, Artificial Sequence
  Synthetic
gcgcgaacuugggacugcag

SEQ ID NO: 1024 - RNA, 20 nt, Artificial Sequence
  Synthetic
gcgcgcagacgucugcgggc

SEQ ID NO: 1025 - RNA, 20 nt, Artificial Sequence
  Synthetic
gcggggcaucccgggagcaa

SEQ ID NO: 1026 - RNA, 20 nt, Artificial Sequence
  Synthetic
ggagaccgcgcggggcaucc

SEQ ID NO: 1027 - RNA, 20 nt, Artificial Sequence
  Synthetic
ggagucguagucucccgaau

SEQ ID NO: 1028 - RNA, 20 nt, Artificial Sequence
  Synthetic
ggccuaugcuucgccauguc

SEQ ID NO: 1029 - RNA, 20 nt, Artificial Sequence
  Synthetic
ggcgggugcgccgaaugcuu

SEQ ID NO: 1030 - RNA, 20 nt, Artificial Sequence
  Synthetic
gggaccaacgcaaggcaagu

SEQ ID NO: 1031 - RNA, 20 nt, Artificial Sequence
  Synthetic
gggagucguagucucccgaa

SEQ ID NO: 1032 - RNA, 20 nt, Artificial Sequence
  Synthetic
gggccuaugcuucgccaugu

SEQ ID NO: 1033 - RNA, 20 nt, Artificial Sequence
  Synthetic
ggggccguccgcaagcagau

SEQ ID NO: 1034 - RNA, 20 nt, Artificial Sequence
  Synthetic
ggucugaggagugacuggca

SEQ ID NO: 1035 - RNA, 20 nt, Artificial Sequence
  Synthetic
gucguagucucccgaauggg

SEQ ID NO: 1036 - RNA, 20 nt, Artificial Sequence
  Synthetic
acacccgcucauccagggcg

SEQ ID NO: 1037 - RNA, 20 nt, Artificial Sequence
  Synthetic
acgucugcgcgcgaaugccg

SEQ ID NO: 1038 - RNA, 20 nt, Artificial Sequence
  Synthetic
auucgcgcgcagacgucugc

SEQ ID NO: 1039 - RNA, 20 nt, Artificial Sequence
  Synthetic
cacccgcucauccagggcga

SEQ ID NO: 1040 - RNA, 20 nt, Artificial Sequence
  Synthetic
caguguccuccgcgcgacgg

SEQ ID NO: 1041 - RNA, 20 nt, Artificial Sequence
  Synthetic
cauucgcgcgcagacgucug

SEQ ID NO: 1042 - RNA, 20 nt, Artificial Sequence
  Synthetic
cgccgucgcgcggaggacac

SEQ ID NO: 1043 - RNA, 20 nt, Artificial Sequence
  Synthetic
cgcgcgcagacgucugcggg

SEQ ID NO: 1044 - RNA, 20 nt, Artificial Sequence
  Synthetic
cggcgcgcgggaccaacgca

SEQ ID NO: 1045 - RNA, 20 nt, Artificial Sequence
  Synthetic
cggcgggugcgccgaaugcu

SEQ ID NO: 1046 - RNA, 20 nt, Artificial Sequence
  Synthetic
cggcggugcggacggugccc

SEQ ID NO: 1047 - RNA, 20 nt, Artificial Sequence
  Synthetic
cgggaccaacgcaaggcaag

SEQ ID NO: 1048 - RNA, 20 nt, Artificial Sequence
  Synthetic
ucccaguguccuccgcgcga

SEQ ID NO: 1049 - RNA, 20 nt, Artificial Sequence
  Synthetic
uccgcgcgacggcggcggug

SEQ ID NO: 1050 - RNA, 20 nt, Artificial Sequence
  Synthetic
ucgcccuggaugagcgggug

SEQ ID NO: 1051 - RNA, 20 nt, Artificial Sequence
  Synthetic
ucgguggaagcgcccccgcg

SEQ ID NO: 1052 - RNA, 20 nt, Artificial Sequence
  Synthetic
ucucuucccgccgugccucg

SEQ ID NO: 1053 - RNA, 20 nt, Artificial Sequence
  Synthetic
ucuucccgccgugccucgcg

SEQ ID NO: 1054 - RNA, 20 nt, Artificial Sequence
  Synthetic
uguccuccgcgcgacggcgg

SEQ ID NO: 1055 - RNA, 20 nt, Artificial Sequence
  Synthetic
uucccucgcccuggaugagc

SEQ ID NO: 1056 - RNA, 22 nt, Artificial Sequence
  Synthetic
gaggcggagggcggcgggugcg

SEQ ID NO: 1057 - RNA, 22 nt, Artificial Sequence
  Synthetic
gagugacuggcagggaaagagg

SEQ ID NO: 1058 - RNA, 22 nt, Artificial Sequence
  Synthetic
ggacacugggagucguagucuc

SEQ ID NO: 1059 - RNA, 22 nt, Artificial Sequence
  Synthetic
ggccuggcccggcccuugcucc

SEQ ID NO: 1060 - RNA, 22 nt, Artificial Sequence
  Synthetic
aaugcccgcgcuuucccucgcc

SEQ ID NO: 1061 - RNA, 22 nt, Artificial Sequence
  Synthetic
agcagaugggaggcggagggcg

SEQ ID NO: 1062 - RNA, 22 nt, Artificial Sequence
  Synthetic
agcggguguggcugagggucug

SEQ ID NO: 1063 - RNA, 22 nt, Artificial Sequence
  Synthetic
ccccgcccgcagacgucugcgc

SEQ ID NO: 1064 - RNA, 22 nt, Artificial Sequence
  Synthetic
cccuggaugagcggguguggcu

SEQ ID NO: 1065 - RNA, 22 nt, Artificial Sequence
  Synthetic
ccgccgucgcgcggaggacacu

SEQ ID NO: 1066 - RNA, 22 nt, Artificial Sequence
  Synthetic
cgaaugggaggagggcgggaaa

SEQ ID NO: 1067 - RNA, 22 nt, Artificial Sequence
  Synthetic
cgccaugucggggugucugcag

SEQ ID NO: 1068 - RNA, 22 nt, Artificial Sequence
  Synthetic
cgcuuucccucgcccuggauga

SEQ ID NO: 1069 - RNA, 22 nt, Artificial Sequence
  Synthetic
ugcagaggcgcgccuggcggau

SEQ ID NO: 1070 - RNA, 22 nt, Artificial Sequence
  Synthetic
ugggacugcagaggcgcgccug

SEQ ID NO: 1071 - RNA, 22 nt, Artificial Sequence
  Synthetic
uggggccuaugcuucgccaugu

SEQ ID NO: 1072 - RNA, 20 nt, Artificial Sequence
  Synthetic
gaaugcaacuacgacccacg

SEQ ID NO: 1073 - RNA, 20 nt, Artificial Sequence
  Synthetic
gacaggcgcuccaaccgucg

SEQ ID NO: 1074 - RNA, 20 nt, Artificial Sequence
  Synthetic
gagccggagaggcaggugag

SEQ ID NO: 1075 - RNA, 20 nt, Artificial Sequence
  Synthetic
gaggcaggugaggggcuacg

SEQ ID NO: 1076 - RNA, 20 nt, Artificial Sequence
  Synthetic
gcgccugucucuuuaaaucc

SEQ ID NO: 1077 - RNA, 20 nt, Artificial Sequence
  Synthetic
gcgcgcaggcgcaagagcca

SEQ ID NO: 1078 - RNA, 20 nt, Artificial Sequence
  Synthetic
ggacccggauuuaaagagac

SEQ ID NO: 1079 - RNA, 20 nt, Artificial Sequence
  Synthetic
ggagccggagaggcagguga

SEQ ID NO: 1080 - RNA, 20 nt, Artificial Sequence
  Synthetic
ggggaccggucgcguggccg

SEQ ID NO: 1081 - RNA, 20 nt, Artificial Sequence
  Synthetic
gggggcggggaccggucgcg

SEQ ID NO: 1082 - RNA, 20 nt, Artificial Sequence
  Synthetic
ggugagcgccggagccggag

SEQ ID NO: 1083 - RNA, 20 nt, Artificial Sequence
  Synthetic
aacuugcucauuacaggccg

SEQ ID NO: 1084 - RNA, 20 nt, Artificial Sequence
  Synthetic
aauccggguccuagagcggg

SEQ ID NO: 1085 - RNA, 20 nt, Artificial Sequence
  Synthetic
acaggcgcuccaaccgucgu

SEQ ID NO: 1086 - RNA, 20 nt, Artificial Sequence
  Synthetic
acuacgacccacguggcaga

SEQ ID NO: 1087 - RNA, 20 nt, Artificial Sequence
  Synthetic
acuugcucauuacaggccgc

SEQ ID NO: 1088 - RNA, 20 nt, Artificial Sequence
  Synthetic
caaccgucgugggcugcccg

SEQ ID NO: 1089 - RNA, 20 nt, Artificial Sequence
  Synthetic
caaggccgcggccacgcgac

SEQ ID NO: 1090 - RNA, 20 nt, Artificial Sequence
  Synthetic
ccggcgcucaccguaggccu

SEQ ID NO: 1091 - RNA, 20 nt, Artificial Sequence
  Synthetic
ccggcuccggcgcucaccgu

SEQ ID NO: 1092 - RNA, 20 nt, Artificial Sequence
  Synthetic
ccuacggugagcgccggagc

SEQ ID NO: 1093 - RNA, 20 nt, Artificial Sequence
  Synthetic
ccucggaacuugcucauuac

SEQ ID NO: 1094 - RNA, 20 nt, Artificial Sequence
  Synthetic
ccuguaaugagcaaguuccg

SEQ ID NO: 1095 - RNA, 20 nt, Artificial Sequence
  Synthetic
cgcgggcagcccacgacggu

SEQ ID NO: 1096 - RNA, 20 nt, Artificial Sequence
  Synthetic
cggucgcguggccgcggccu

SEQ ID NO: 1097 - RNA, 20 nt, Artificial Sequence
  Synthetic
cuacgacccacguggcagac

SEQ ID NO: 1098 - RNA, 20 nt, Artificial Sequence
  Synthetic
uacgacccacguggcagacg

SEQ ID NO: 1099 - RNA, 20 nt, Artificial Sequence
  Synthetic
uagagcgggaggcagcgcgc

SEQ ID NO: 1100 - RNA, 20 nt, Artificial Sequence
  Synthetic
ugagcaaguuccgaggccua

SEQ ID NO: 1101 - RNA, 20 nt, Artificial Sequence
  Synthetic
uuaaauccggguccuagagc

SEQ ID NO: 1102 - RNA, 20 nt, Artificial Sequence
  Synthetic
uuuaaauccggguccuagag

SEQ ID NO: 1103 - RNA, 22 nt, Artificial Sequence
  Synthetic
gcgcugccucccgcucuaggac

SEQ ID NO: 1104 - RNA, 22 nt, Artificial Sequence
  Synthetic
gguccccgcccccgucugccac

SEQ ID NO: 1105 - RNA, 22 nt, Artificial Sequence
  Synthetic
cucccaaacaucacagggcagg

SEQ ID NO: 1106 - RNA, 22 nt, Artificial Sequence
  Synthetic
uggagcgccugucucuuuaaau

SEQ ID NO: 1107 - RNA, 22 nt, Artificial Sequence
  Synthetic
uucugccugcccugugauguuu

SEQ ID NO: 1108 - RNA, 20 nt, Artificial Sequence
  Synthetic
gaacucuaugguuccggggc

SEQ ID NO: 1109 - RNA, 20 nt, Artificial Sequence
  Synthetic
gagggaggacgcugggacug

SEQ ID NO: 1110 - RNA, 20 nt, Artificial Sequence
  Synthetic
gcuccuuccccacgagucua

SEQ ID NO: 1111 - RNA, 20 nt, Artificial Sequence
  Synthetic
ggacuguggcuugcccugau

SEQ ID NO: 1112 - RNA, 20 nt, Artificial Sequence
  Synthetic
ggagguuugaguuugaagac

SEQ ID NO: 1113 - RNA, 20 nt, Artificial Sequence
  Synthetic
ggggaaggagcggcucucgc

SEQ ID NO: 1114 - RNA, 20 nt, Artificial Sequence
  Synthetic
gguuugaguuugaagacugg

SEQ ID NO: 1115 - RNA, 20 nt, Artificial Sequence
  Synthetic
gucccagcguccucccucuc

SEQ ID NO: 1116 - RNA, 20 nt, Artificial Sequence
  Synthetic
gucuucaaacucaaaccucc

SEQ ID NO: 1117 - RNA, 20 nt, Artificial Sequence
  Synthetic
guuugaguuugaagacuggc

SEQ ID NO: 1118 - RNA, 20 nt, Artificial Sequence
  Synthetic
aagccauagacucgugggga

SEQ ID NO: 1119 - RNA, 20 nt, Artificial Sequence
  Synthetic
acccgaaagccauagacucg

SEQ ID NO: 1120 - RNA, 20 nt, Artificial Sequence
  Synthetic
agaacucuaugguuccgggg

SEQ ID NO: 1121 - RNA, 20 nt, Artificial Sequence
  Synthetic
aggccaggguucucccgaga

SEQ ID NO: 1122 - RNA, 20 nt, Artificial Sequence
  Synthetic
cacggagaacucuaugguuc

SEQ ID NO: 1123 - RNA, 20 nt, Artificial Sequence
  Synthetic
caggccaggguucucccgag

SEQ ID NO: 1124 - RNA, 20 nt, Artificial Sequence
  Synthetic
ccaggguucucccgagaggg

SEQ ID NO: 1125 - RNA, 20 nt, Artificial Sequence
  Synthetic
cccacgagucuauggcuuuc

SEQ ID NO: 1126 - RNA, 20 nt, Artificial Sequence
  Synthetic
ccccacgagucuauggcuuu

SEQ ID NO: 1127 - RNA, 20 nt, Artificial Sequence
  Synthetic
cccgaaagccauagacucgu

SEQ ID NO: 1128 - RNA, 20 nt, Artificial Sequence
  Synthetic
ccgaaagccauagacucgug

SEQ ID NO: 1129 - RNA, 20 nt, Artificial Sequence
  Synthetic
cggaaccauagaguucuccg

SEQ ID NO: 1130 - RNA, 20 nt, Artificial Sequence
  Synthetic
cggagaacucuaugguuccg

SEQ ID NO: 1131 - RNA, 20 nt, Artificial Sequence
  Synthetic
cuaugguuccggggcgggcc

SEQ ID NO: 1132 - RNA, 20 nt, Artificial Sequence
  Synthetic
cucccgagagggaggacgcu

SEQ ID NO: 1133 - RNA, 20 nt, Artificial Sequence
  Synthetic
ucaaaccucccggcccgccc

SEQ ID NO: 1134 - RNA, 20 nt, Artificial Sequence
  Synthetic
ucgcuggcgucuaagacuuc

SEQ ID NO: 1135 - RNA, 20 nt, Artificial Sequence
  Synthetic
ucuaugguuccggggcgggc

SEQ ID NO: 1136 - RNA, 20 nt, Artificial Sequence
  Synthetic
ucucccgagagggaggacgc

SEQ ID NO: 1137 - RNA, 20 nt, Artificial Sequence
  Synthetic
uuaagccacggagaacucua

SEQ ID NO: 1138 - RNA, 22 nt, Artificial Sequence
  Synthetic
guuccggggcgggccgggaggu

SEQ ID NO: 1139 - RNA, 22 nt, Artificial Sequence
  Synthetic
auguccgcagcuguugccaggc

SEQ ID NO: 1140 - RNA, 22 nt, Artificial Sequence
  Synthetic
cagcgagagccgcuccuucccc

SEQ ID NO: 1141 - RNA, 22 nt, Artificial Sequence
  Synthetic
cucccggcccgccccggaacca

SEQ ID NO: 1142 - RNA, 22 nt, Artificial Sequence
  Synthetic
cuuccccacgagucuauggcuu

SEQ ID NO: 1143 - RNA, 22 nt, Artificial Sequence
  Synthetic
uggcuugcccugaucggccgag

SEQ ID NO: 1144 - RNA, 20 nt, Artificial Sequence
  Synthetic
gaagcgcccgccgccggagc

SEQ ID NO: 1145 - RNA, 20 nt, Artificial Sequence
  Synthetic
gaccaaucgggacgcgagac

SEQ ID NO: 1146 - RNA, 20 nt, Artificial Sequence
  Synthetic
gaccggagggggcgugcuga

SEQ ID NO: 1147 - RNA, 20 nt, Artificial Sequence
  Synthetic
gacggcccccgcgaccaauc

SEQ ID NO: 1148 - RNA, 20 nt, Artificial Sequence
  Synthetic
gagcucgcggaggaagucgg

SEQ ID NO: 1149 - RNA, 20 nt, Artificial Sequence
  Synthetic
gaggaagucggcgggcgucu

SEQ ID NO: 1150 - RNA, 20 nt, Artificial Sequence
  Synthetic
gcacuguggcgcuccggacc

SEQ ID NO: 1151 - RNA, 20 nt, Artificial Sequence
  Synthetic
gcggagcucgcggaggaagu

SEQ ID NO: 1152 - RNA, 20 nt, Artificial Sequence
  Synthetic
ggaccccccgcgcaggaccc

SEQ ID NO: 1153 - RNA, 20 nt, Artificial Sequence
  Synthetic
ggagggggcgugcugacgga

SEQ ID NO: 1154 - RNA, 20 nt, Artificial Sequence
  Synthetic
ggccgucaguccggcuccgg

SEQ ID NO: 1155 - RNA, 20 nt, Artificial Sequence
  Synthetic
gggacgcugggcugagcggc

SEQ ID NO: 1156 - RNA, 20 nt, Artificial Sequence
  Synthetic
gggggccgucaguccggcuc

SEQ ID NO: 1157 - RNA, 20 nt, Artificial Sequence
  Synthetic
ggguccugcgcggggggucc

SEQ ID NO: 1158 - RNA, 20 nt, Artificial Sequence
  Synthetic
ggucgcgggggccgucaguc

SEQ ID NO: 1159 - RNA, 20 nt, Artificial Sequence
  Synthetic
gucaguccggcuccggcggc

SEQ ID NO: 1160 - RNA, 20 nt, Artificial Sequence
  Synthetic
guccgucagcacgcccccuc

SEQ ID NO: 1161 - RNA, 20 nt, Artificial Sequence
  Synthetic
gucugcggccucacgcacug

SEQ ID NO: 1162 - RNA, 20 nt, Artificial Sequence
  Synthetic
gugaggccgcagacguggca

SEQ ID NO: 1163 - RNA, 20 nt, Artificial Sequence
  Synthetic
gugggaggggcuccgccgug

SEQ ID NO: 1164 - RNA, 20 nt, Artificial Sequence
  Synthetic
aaccuccgggguccugcgcg

SEQ ID NO: 1165 - RNA, 20 nt, Artificial Sequence
  Synthetic
aaucgggacgcgagaccgga

SEQ ID NO: 1166 - RNA, 20 nt, Artificial Sequence
  Synthetic
accuccgggguccugcgcgg

SEQ ID NO: 1167 - RNA, 20 nt, Artificial Sequence
  Synthetic
agaggaggagcucgcugccg

SEQ ID NO: 1168 - RNA, 20 nt, Artificial Sequence
  Synthetic
agcucgcggaggaagucggc

SEQ ID NO: 1169 - RNA, 20 nt, Artificial Sequence
  Synthetic
aggaagucggcgggcgucuc

SEQ ID NO: 1170 - RNA, 20 nt, Artificial Sequence
  Synthetic
agugcgugaggccgcagacg

SEQ ID NO: 1171 - RNA, 20 nt, Artificial Sequence
  Synthetic
aucgggacgcgagaccggag

SEQ ID NO: 1172 - RNA, 20 nt, Artificial Sequence
  Synthetic
caaucgggacgcgagaccgg

SEQ ID NO: 1173 - RNA, 20 nt, Artificial Sequence
  Synthetic
cgccgccggagccggacuga

SEQ ID NO: 1174 - RNA, 20 nt, Artificial Sequence
  Synthetic
cgcgucccgauuggucgcgg

SEQ ID NO: 1175 - RNA, 20 nt, Artificial Sequence
  Synthetic
cggcgggcgucucgggcucc

SEQ ID NO: 1176 - RNA, 20 nt, Artificial Sequence
  Synthetic
cgucaguccggcuccggcgg

SEQ ID NO: 1177 - RNA, 20 nt, Artificial Sequence
  Synthetic
cuccggucucgcgucccgau

SEQ ID NO: 1178 - RNA, 20 nt, Artificial Sequence
  Synthetic
cucgcgucccgauuggucgc

SEQ ID NO: 1179 - RNA, 20 nt, Artificial Sequence
  Synthetic
uaaccuccgggguccugcgc

SEQ ID NO: 1180 - RNA, 20 nt, Artificial Sequence
  Synthetic
ucgcgucccgauuggucgcg

SEQ ID NO: 1181 - RNA, 20 nt, Artificial Sequence
  Synthetic
ucucgcgucccgauuggucg

SEQ ID NO: 1182 - RNA, 20 nt, Artificial Sequence
  Synthetic
ugacggcccccgcgaccaau

SEQ ID NO: 1183 - RNA, 20 nt, Artificial Sequence
  Synthetic
uuaaccuccgggguccugcg

SEQ ID NO: 1184 - RNA, 22 nt, Artificial Sequence
  Synthetic
gccguguggaaaacuuaaccuc

SEQ ID NO: 1185 - RNA, 22 nt, Artificial Sequence
  Synthetic
gcgggcccggcggcggcggcag

SEQ ID NO: 1186 - RNA, 22 nt, Artificial Sequence
  Synthetic
gcgugaggccgcagacguggca

SEQ ID NO: 1187 - RNA, 22 nt, Artificial Sequence
  Synthetic
ccggcggcggcggcagcggggu

SEQ ID NO: 1188 - RNA, 22 nt, Artificial Sequence
  Synthetic
uccugcgcgggggguccgggcc

SEQ ID NO: 1189 - RNA, 22 nt, Artificial Sequence
  Synthetic
uuaaccuccgggguccugcgcg

SEQ ID NO: 1190 - RNA, 20 nt, Artificial Sequence
  Synthetic
gaaacuguucccccgcggag

SEQ ID NO: 1191 - RNA, 20 nt, Artificial Sequence
  Synthetic
gaacgcgcaaaacgccgugu

SEQ ID NO: 1192 - RNA, 20 nt, Artificial Sequence
  Synthetic
gacggguggcggcccucgac

SEQ ID NO: 1193 - RNA, 20 nt, Artificial Sequence
  Synthetic
gagcaggcggacccccuccg

SEQ ID NO: 1194 - RNA, 20 nt, Artificial Sequence
  Synthetic
gaggggguccgccugcucuu

SEQ ID NO: 1195 - RNA, 20 nt, Artificial Sequence
  Synthetic
gcacuuccgccccccacuuc

SEQ ID NO: 1196 - RNA, 20 nt, Artificial Sequence
  Synthetic
gcaggcggacccccuccgcg

SEQ ID NO: 1197 - RNA, 20 nt, Artificial Sequence
  Synthetic
gccugcucuucggcuccucc

SEQ ID NO: 1198 - RNA, 20 nt, Artificial Sequence
  Synthetic
gccuggaggagccgaagagc

SEQ ID NO: 1199 - RNA, 20 nt, Artificial Sequence
  Synthetic
gcggcgaaccuuccagaacc

SEQ ID NO: 1200 - RNA, 20 nt, Artificial Sequence
  Synthetic
gcgggggaacaguuuccgcc

SEQ ID NO: 1201 - RNA, 20 nt, Artificial Sequence
  Synthetic
gcuggcugacagcuggggac

SEQ ID NO: 1202 - RNA, 20 nt, Artificial Sequence
  Synthetic
ggaaacuguucccccgcgga

SEQ ID NO: 1203 - RNA, 20 nt, Artificial Sequence
  Synthetic
ggagucgguugaguuccuga

SEQ ID NO: 1204 - RNA, 20 nt, Artificial Sequence
  Synthetic
ggcugacagcuggggacggg

SEQ ID NO: 1205 - RNA, 20 nt, Artificial Sequence
  Synthetic
gggagcacaaagcaacggac

SEQ ID NO: 1206 - RNA, 20 nt, Artificial Sequence
  Synthetic
gguccguugcuuugugcucc

SEQ ID NO: 1207 - RNA, 20 nt, Artificial Sequence
  Synthetic
guggggggcggaagugcagu

SEQ ID NO: 1208 - RNA, 20 nt, Artificial Sequence
  Synthetic
guugaguuccugagggaccc

SEQ ID NO: 1209 - RNA, 20 nt, Artificial Sequence
  Synthetic
aaaacgccguguaggccugg

SEQ ID NO: 1210 - RNA, 20 nt, Artificial Sequence
  Synthetic
aaacuguucccccgcggagg

SEQ ID NO: 1211 - RNA, 20 nt, Artificial Sequence
  Synthetic
aaagcaacggaccggaagug

SEQ ID NO: 1212 - RNA, 20 nt, Artificial Sequence
  Synthetic
aacggaccggaagugggggg

SEQ ID NO: 1213 - RNA, 20 nt, Artificial Sequence
  Synthetic
aacucaaccgacuccagucg

SEQ ID NO: 1214 - RNA, 20 nt, Artificial Sequence
  Synthetic
acaaagcaacggaccggaag

SEQ ID NO: 1215 - RNA, 20 nt, Artificial Sequence
  Synthetic
acucaaccgacuccagucga

SEQ ID NO: 1216 - RNA, 20 nt, Artificial Sequence
  Synthetic
acucugagcuggcugacagc

SEQ ID NO: 1217 - RNA, 20 nt, Artificial Sequence
  Synthetic
agcaacggaccggaaguggg

SEQ ID NO: 1218 - RNA, 20 nt, Artificial Sequence
  Synthetic
agccagcucagaguuuucgc

SEQ ID NO: 1219 - RNA, 20 nt, Artificial Sequence
  Synthetic
caaagcaacggaccggaagu

SEQ ID NO: 1220 - RNA, 20 nt, Artificial Sequence
  Synthetic
cgcaaaacgccguguaggcc

SEQ ID NO: 1221 - RNA, 20 nt, Artificial Sequence
  Synthetic
cgcggcgaaccuuccagaac

SEQ ID NO: 1222 - RNA, 20 nt, Artificial Sequence
  Synthetic
cgcgggggaacaguuuccgc

SEQ ID NO: 1223 - RNA, 20 nt, Artificial Sequence
  Synthetic
cggaaacuguucccccgcgg

SEQ ID NO: 1224 - RNA, 20 nt, Artificial Sequence
  Synthetic
cggcggaaacuguucccccg

SEQ ID NO: 1225 - RNA, 20 nt, Artificial Sequence
  Synthetic
cgguucuggaagguucgccg

SEQ ID NO: 1226 - RNA, 20 nt, Artificial Sequence
  Synthetic
cguuuugcgcguucuguguc

SEQ ID NO: 1227 - RNA, 20 nt, Artificial Sequence
  Synthetic
ugcccgcgaaaacucugagc

SEQ ID NO: 1228 - RNA, 20 nt, Artificial Sequence
  Synthetic
uuccugagggaccccgguuc

SEQ ID NO: 1229 - RNA, 22 nt, Artificial Sequence
  Synthetic
gcggaaacuguucccccgcgga

SEQ ID NO: 1230 - RNA, 22 nt, Artificial Sequence
  Synthetic
ggcggcccucgacuggagucgg

SEQ ID NO: 1231 - RNA, 22 nt, Artificial Sequence
  Synthetic
gggacggguggcggcccucgac

SEQ ID NO: 1232 - RNA, 22 nt, Artificial Sequence
  Synthetic
cguccccagcugucagccagcu

SEQ ID NO: 1233 - RNA, 22 nt, Artificial Sequence
  Synthetic
cugagcuggcugacagcugggg

SEQ ID NO: 1234 - RNA, 22 nt, Artificial Sequence
  Synthetic
uccgcggcgaaccuuccagaac

SEQ ID NO: 1235 - RNA, 20 nt, Artificial Sequence
  Synthetic
gaauacaguucaaaccucgc

SEQ ID NO: 1236 - RNA, 20 nt, Artificial Sequence
  Synthetic
gacgcgagacuuacgugauu

SEQ ID NO: 1237 - RNA, 20 nt, Artificial Sequence
  Synthetic
gagcgcagcgauuggcuccc

SEQ ID NO: 1238 - RNA, 20 nt, Artificial Sequence
  Synthetic
gaggcaggcuggucuuccuu

SEQ ID NO: 1239 - RNA, 20 nt, Artificial Sequence
  Synthetic
gagguuugaacuguauucag

SEQ ID NO: 1240 - RNA, 20 nt, Artificial Sequence
  Synthetic
gcauuuuuaaguggugauuc

SEQ ID NO: 1241 - RNA, 20 nt, Artificial Sequence
  Synthetic
gccgcgggagggcaucccgu

SEQ ID NO: 1242 - RNA, 20 nt, Artificial Sequence
  Synthetic
gcgacugcggcggccgcggg

SEQ ID NO: 1243 - RNA, 20 nt, Artificial Sequence
  Synthetic
gcgcgucgcggcagccccca

SEQ ID NO: 1244 - RNA, 20 nt, Artificial Sequence
  Synthetic
gcggcgacugcggcggccgc

SEQ ID NO: 1245 - RNA, 20 nt, Artificial Sequence
  Synthetic
gcugcgcucgcccuccgacc

SEQ ID NO: 1246 - RNA, 20 nt, Artificial Sequence
  Synthetic
ggcaggcuggucuuccuugg

SEQ ID NO: 1247 - RNA, 20 nt, Artificial Sequence
  Synthetic
ggcgacagcggcgacugcgg

SEQ ID NO: 1248 - RNA, 20 nt, Artificial Sequence
  Synthetic
ggcucccggggccucccgcg

SEQ ID NO: 1249 - RNA, 20 nt, Artificial Sequence
  Synthetic
ggcucugcuuccgggucgga

SEQ ID NO: 1250 - RNA, 20 nt, Artificial Sequence
  Synthetic
ggggcugccgcgacgcgcug

SEQ ID NO: 1251 - RNA, 20 nt, Artificial Sequence
  Synthetic
gugugcggaaggauccccaa

SEQ ID NO: 1252 - RNA, 20 nt, Artificial Sequence
  Synthetic
aagacguacucuucagugug

SEQ ID NO: 1253 - RNA, 20 nt, Artificial Sequence
  Synthetic
acgcgagacuuacgugauua

SEQ ID NO: 1254 - RNA, 20 nt, Artificial Sequence
  Synthetic
acgcgcuguggcucugcuuc

SEQ ID NO: 1255 - RNA, 20 nt, Artificial Sequence
  Synthetic
acuguauucagcggcgacag

SEQ ID NO: 1256 - RNA, 20 nt, Artificial Sequence
  Synthetic
agcagagccacagcgcgucg

SEQ ID NO: 1257 - RNA, 20 nt, Artificial Sequence
  Synthetic
agcgcagcgauuggcucccg

SEQ ID NO: 1258 - RNA, 20 nt, Artificial Sequence
  Synthetic
cacacugaagaguacgucuu

SEQ ID NO: 1259 - RNA, 20 nt, Artificial Sequence
  Synthetic
cccaacgggaugcccucccg

SEQ ID NO: 1260 - RNA, 20 nt, Artificial Sequence
  Synthetic
ccgcgggagggcaucccguu

SEQ ID NO: 1261 - RNA, 20 nt, Artificial Sequence
  Synthetic
cgagcgcagcgauuggcucc

SEQ ID NO: 1262 - RNA, 20 nt, Artificial Sequence
  Synthetic
cgcgagacuuacgugauuag

SEQ ID NO: 1263 - RNA, 20 nt, Artificial Sequence
  Synthetic
cgcgggagggcaucccguug

SEQ ID NO: 1264 - RNA, 20 nt, Artificial Sequence
  Synthetic
cggagggcgagcgcagcgau

SEQ ID NO: 1265 - RNA, 20 nt, Artificial Sequence
  Synthetic
cguacucuucagugugcgga

SEQ ID NO: 1266 - RNA, 20 nt, Artificial Sequence
  Synthetic
uacaguucaaaccucgcggg

SEQ ID NO: 1267 - RNA, 20 nt, Artificial Sequence
  Synthetic
ucaaaccucgcgggaggccc

SEQ ID NO: 1268 - RNA, 20 nt, Artificial Sequence
  Synthetic
ucaccacuuaaaaaugcgac

SEQ ID NO: 1269 - RNA, 20 nt, Artificial Sequence
  Synthetic
ugaauacaguucaaaccucg

SEQ ID NO: 1270 - RNA, 20 nt, Artificial Sequence
  Synthetic
ugcccugucgcauuuuuaag

SEQ ID NO: 1271 - RNA, 20 nt, Artificial Sequence
  Synthetic
ugugcggaaggauccccaac

SEQ ID NO: 1272 - RNA, 22 nt, Artificial Sequence
  Synthetic
gccgcagucgccgcugucgccg

SEQ ID NO: 1273 - RNA, 22 nt, Artificial Sequence
  Synthetic
gcgacgcgcuguggcucugcuu

SEQ ID NO: 1274 - RNA, 22 nt, Artificial Sequence
  Synthetic
ggccgcgggagggcaucccguu

SEQ ID NO: 1275 - RNA, 22 nt, Artificial Sequence
  Synthetic
agacguacucuucagugugcgg

SEQ ID NO: 1276 - RNA, 22 nt, Artificial Sequence
  Synthetic
cagacgcgagacuuacgugauu

SEQ ID NO: 1277 - RNA, 22 nt, Artificial Sequence
  Synthetic
cagugugcggaaggauccccaa

SEQ ID NO: 1278 - RNA, 22 nt, Artificial Sequence
  Synthetic
ccgcacacugaagaguacgucu

SEQ ID NO: 1279 - RNA, 22 nt, Artificial Sequence
  Synthetic
uuggggauccuuccgcacacug

SEQ ID NO: 1280 - RNA, 20 nt, Artificial Sequence
  Synthetic
gaauccgccccggaaucggg

SEQ ID NO: 1281 - RNA, 20 nt, Artificial Sequence
  Synthetic
gaccggccauuacuggugcc

SEQ ID NO: 1282 - RNA, 20 nt, Artificial Sequence
  Synthetic
gacuuaaccaacccccgccg

SEQ ID NO: 1283 - RNA, 20 nt, Artificial Sequence
  Synthetic
gcaccaguaauggccggucc

SEQ ID NO: 1284 - RNA, 20 nt, Artificial Sequence
  Synthetic
gccacacguugggagcgcgg

SEQ ID NO: 1285 - RNA, 20 nt, Artificial Sequence
  Synthetic
gccgccacacguugggagcg

SEQ ID NO: 1286 - RNA, 20 nt, Artificial Sequence
  Synthetic
gcgucgcgagagacacaccc

SEQ ID NO: 1287 - RNA, 20 nt, Artificial Sequence
  Synthetic
ggacguaccaacugcgcggg

SEQ ID NO: 1288 - RNA, 20 nt, Artificial Sequence
  Synthetic
ggcggcggguacucacucgc

SEQ ID NO: 1289 - RNA, 20 nt, Artificial Sequence
  Synthetic
ggggugugucucucgcgacg

SEQ ID NO: 1290 - RNA, 20 nt, Artificial Sequence
  Synthetic
gggugugucucucgcgacgc

SEQ ID NO: 1291 - RNA, 20 nt, Artificial Sequence
  Synthetic
ggucgcgagccgccacacgu

SEQ ID NO: 1292 - RNA, 20 nt, Artificial Sequence
  Synthetic
ggugugucucucgcgacgcg

SEQ ID NO: 1293 - RNA, 20 nt, Artificial Sequence
  Synthetic
guagaccuucuccggguugc

SEQ ID NO: 1294 - RNA, 20 nt, Artificial Sequence
  Synthetic
gucccuccggacgccgaagu

SEQ ID NO: 1295 - RNA, 20 nt, Artificial Sequence
  Synthetic
guccgcggcccgcuacucuc

SEQ ID NO: 1296 - RNA, 20 nt, Artificial Sequence
  Synthetic
gucgcgagccgccacacguu

SEQ ID NO: 1297 - RNA, 20 nt, Artificial Sequence
  Synthetic
gucucucgcgacgcgggggu

SEQ ID NO: 1298 - RNA, 20 nt, Artificial Sequence
  Synthetic
guguggcggcucgcgacccc

SEQ ID NO: 1299 - RNA, 20 nt, Artificial Sequence
  Synthetic
gugugucucucgcgacgcgg

SEQ ID NO: 1300 - RNA, 20 nt, Artificial Sequence
  Synthetic
aacccggcaccaguaauggc

SEQ ID NO: 1301 - RNA, 20 nt, Artificial Sequence
  Synthetic
aauccgccccggaaucggga

SEQ ID NO: 1302 - RNA, 20 nt, Artificial Sequence
  Synthetic
acgccgggaccggccauuac

SEQ ID NO: 1303 - RNA, 20 nt, Artificial Sequence
  Synthetic
acuuaaccaacccccgccgc

SEQ ID NO: 1304 - RNA, 20 nt, Artificial Sequence
  Synthetic
agcccacuucggcguccgga

SEQ ID NO: 1305 - RNA, 20 nt, Artificial Sequence
  Synthetic
agguaggccucucccgacgc

SEQ ID NO: 1306 - RNA, 20 nt, Artificial Sequence
  Synthetic
cccgauuccggggcggauuc

SEQ ID NO: 1307 - RNA, 20 nt, Artificial Sequence
  Synthetic
cccgcgcaguugguacgucc

SEQ ID NO: 1308 - RNA, 20 nt, Artificial Sequence
  Synthetic
ccgccccgagagcgugucuc

SEQ ID NO: 1309 - RNA, 20 nt, Artificial Sequence
  Synthetic
ccggaauccgccccggaauc

SEQ ID NO: 1310 - RNA, 20 nt, Artificial Sequence
  Synthetic
ccgggacguaccaacugcgc

SEQ ID NO: 1311 - RNA, 20 nt, Artificial Sequence
  Synthetic
cgcaguugguacgucccgga

SEQ ID NO: 1312 - RNA, 20 nt, Artificial Sequence
  Synthetic
cggcccgcuacucuccggga

SEQ ID NO: 1313 - RNA, 20 nt, Artificial Sequence
  Synthetic
cgucccggauggcucccccg

SEQ ID NO: 1314 - RNA, 20 nt, Artificial Sequence
  Synthetic
uaauggccggucccggcguc

SEQ ID NO: 1315 - RNA, 20 nt, Artificial Sequence
  Synthetic
uccggaauccgccccggaau

SEQ ID NO: 1316 - RNA, 20 nt, Artificial Sequence
  Synthetic
uccggacgccgaagugggcu

SEQ ID NO: 1317 - RNA, 20 nt, Artificial Sequence
  Synthetic
uccgggacguaccaacugcg

SEQ ID NO: 1318 - RNA, 20 nt, Artificial Sequence
  Synthetic
ugucucucgcgacgcggggg

SEQ ID NO: 1319 - RNA, 20 nt, Artificial Sequence
  Synthetic
uuaaccaacccccgccgcgg

SEQ ID NO: 1320 - RNA, 22 nt, Artificial Sequence
  Synthetic
gcgucgggaagcgccccucccg

SEQ ID NO: 1321 - RNA, 22 nt, Artificial Sequence
  Synthetic
gcuggccuugccgaagucgggg

SEQ ID NO: 1322 - RNA, 22 nt, Artificial Sequence
  Synthetic
gucuacagagcggccugcgcca

SEQ ID NO: 1323 - RNA, 22 nt, Artificial Sequence
  Synthetic
acagagcggccugcgccagcga

SEQ ID NO: 1324 - RNA, 22 nt, Artificial Sequence
  Synthetic
aguaauggccggucccggcguc

SEQ ID NO: 1325 - RNA, 22 nt, Artificial Sequence
  Synthetic
caggccgcucuguagaccuucu

SEQ ID NO: 1326 - RNA, 22 nt, Artificial Sequence
  Synthetic
cccugccuccuuuucuuccuca

SEQ ID NO: 1327 - RNA, 22 nt, Artificial Sequence
  Synthetic
ccggaauccgccccggaaucgg

SEQ ID NO: 1328 - RNA, 22 nt, Artificial Sequence
  Synthetic
ccgggaccggccauuacuggug

SEQ ID NO: 1329 - RNA, 22 nt, Artificial Sequence
  Synthetic
ccggggcggcccuuccugaugc

SEQ ID NO: 1330 - RNA, 22 nt, Artificial Sequence
  Synthetic
ccucccgcgcaguugguacguc

SEQ ID NO: 1331 - RNA, 22 nt, Artificial Sequence
  Synthetic
ccuccggacgccgaagugggcu

SEQ ID NO: 1332 - RNA, 22 nt, Artificial Sequence
  Synthetic
cggggcuggccuugccgaaguc

SEQ ID NO: 1333 - RNA, 22 nt, Artificial Sequence
  Synthetic
cggggugugucucucgcgacgc

SEQ ID NO: 1334 - RNA, 22 nt, Artificial Sequence
  Synthetic
cugggacccucccgauuccggg

SEQ ID NO: 1335 - RNA, 22 nt, Artificial Sequence
  Synthetic
ucccggauggcucccccgcggc

SEQ ID NO: 1336 - RNA, 22 nt, Artificial Sequence
  Synthetic
ucccggcguccggaauccgccc

SEQ ID NO: 1337 - RNA, 22 nt, Artificial Sequence
  Synthetic
ugaggaagaaaaggaggcaggg

SEQ ID NO: 1338 - RNA, 22 nt, Artificial Sequence
  Synthetic
ugggcggagcugugcgcaggcg

SEQ ID NO: 1339 - RNA, 22 nt, Artificial Sequence
  Synthetic
uguagaccuucuccggguugcc

SEQ ID NO: 1340 - RNA, 20 nt, Artificial Sequence
  Synthetic
gaacccacgcccagcgccgg

SEQ ID NO: 1341 - RNA, 20 nt, Artificial Sequence
  Synthetic
gaaccguaaaucaagucgga

SEQ ID NO: 1342 - RNA, 20 nt, Artificial Sequence
  Synthetic
gaaggaaccguaaaucaagu

SEQ ID NO: 1343 - RNA, 20 nt, Artificial Sequence
  Synthetic
gaagggugcgcgagcgucuc

SEQ ID NO: 1344 - RNA, 20 nt, Artificial Sequence
  Synthetic
gagagcggcuucccccgggg

SEQ ID NO: 1345 - RNA, 20 nt, Artificial Sequence
  Synthetic
gaggagagcggcuucccccg

SEQ ID NO: 1346 - RNA, 20 nt, Artificial Sequence
  Synthetic
gaggccgcgcagaggagaau

SEQ ID NO: 1347 - RNA, 20 nt, Artificial Sequence
  Synthetic
gcacacagggagcucgaucu

SEQ ID NO: 1348 - RNA, 20 nt, Artificial Sequence
  Synthetic
gcagccccagguucucgacc

SEQ ID NO: 1349 - RNA, 20 nt, Artificial Sequence
  Synthetic
gcugcccgaggcgcguaagu

SEQ ID NO: 1350 - RNA, 20 nt, Artificial Sequence
  Synthetic
gcuuccgggucgagaaccug

SEQ ID NO: 1351 - RNA, 20 nt, Artificial Sequence
  Synthetic
ggaaccguaaaucaagucgg

SEQ ID NO: 1352 - RNA, 20 nt, Artificial Sequence
  Synthetic
ggaggagagcggcuuccccc

SEQ ID NO: 1353 - RNA, 20 nt, Artificial Sequence
  Synthetic
ggaggccgcgcagaggagaa

SEQ ID NO: 1354 - RNA, 20 nt, Artificial Sequence
  Synthetic
ggcagcgcgcggugcacaca

SEQ ID NO: 1355 - RNA, 20 nt, Artificial Sequence
  Synthetic
gggaggagagcggcuucccc

SEQ ID NO: 1356 - RNA, 20 nt, Artificial Sequence
  Synthetic
gggcagcgcgcggugcacac

SEQ ID NO: 1357 - RNA, 20 nt, Artificial Sequence
  Synthetic
ggggaagagaucuuagaugg

SEQ ID NO: 1358 - RNA, 20 nt, Artificial Sequence
  Synthetic
ggugaacuagaacaggccuc

SEQ ID NO: 1359 - RNA, 20 nt, Artificial Sequence
  Synthetic
ggugguucuagccgugggug

SEQ ID NO: 1360 - RNA, 20 nt, Artificial Sequence
  Synthetic
aaccguaaaucaagucggag

SEQ ID NO: 1361 - RNA, 20 nt, Artificial Sequence
  Synthetic
acccacggcuagaaccaccc

SEQ ID NO: 1362 - RNA, 20 nt, Artificial Sequence
  Synthetic
agcuuccgggucgagaaccu

SEQ ID NO: 1363 - RNA, 20 nt, Artificial Sequence
  Synthetic
agggagcucgaucuaggcua

SEQ ID NO: 1364 - RNA, 20 nt, Artificial Sequence
  Synthetic
cacggcuagaaccaccccgg

SEQ ID NO: 1365 - RNA, 20 nt, Artificial Sequence
  Synthetic
cagcuuccgggucgagaacc

SEQ ID NO: 1366 - RNA, 20 nt, Artificial Sequence
  Synthetic
ccacggcuagaaccaccccg

SEQ ID NO: 1367 - RNA, 20 nt, Artificial Sequence
  Synthetic
cccacggcuagaaccacccc

SEQ ID NO: 1368 - RNA, 20 nt, Artificial Sequence
  Synthetic
ccccggggugguucuagccg

SEQ ID NO: 1369 - RNA, 20 nt, Artificial Sequence
  Synthetic
cccggggugguucuagccgu

SEQ ID NO: 1370 - RNA, 20 nt, Artificial Sequence
  Synthetic
ccgaggcgcguaaguggggg

SEQ ID NO: 1371 - RNA, 20 nt, Artificial Sequence
  Synthetic
ccucccccacuuacgcgccu

SEQ ID NO: 1372 - RNA, 20 nt, Artificial Sequence
  Synthetic
cgcgagcgucucugggaaga

SEQ ID NO: 1373 - RNA, 20 nt, Artificial Sequence
  Synthetic
cgcugcccgaggcgcguaag

SEQ ID NO: 1374 - RNA, 20 nt, Artificial Sequence
  Synthetic
cucgaucuaggcuauggaca

SEQ ID NO: 1375 - RNA, 20 nt, Artificial Sequence
  Synthetic
cuuagauggaggccgcgcag

SEQ ID NO: 1376 - RNA, 20 nt, Artificial Sequence
  Synthetic
uacgcgccucgggcagcgcg

SEQ ID NO: 1377 - RNA, 20 nt, Artificial Sequence
  Synthetic
uccgaacccacgcccagcgc

SEQ ID NO: 1378 - RNA, 20 nt, Artificial Sequence
  Synthetic
ucgaucuaggcuauggacaa

SEQ ID NO: 1379 - RNA, 20 nt, Artificial Sequence
  Synthetic
ugcccgaggcgcguaagugg

SEQ ID NO: 1380 - RNA, 22 nt, Artificial Sequence
  Synthetic
ggagcgugggaaggcucagcuu

SEQ ID NO: 1381 - RNA, 22 nt, Artificial Sequence
  Synthetic
gggggaggagagcggcuucccc

SEQ ID NO: 1382 - RNA, 22 nt, Artificial Sequence
  Synthetic
aggccgcgcagaggagaauggg

SEQ ID NO: 1383 - RNA, 22 nt, Artificial Sequence
  Synthetic
cagcaucucuacgcugagaccu

SEQ ID NO: 1384 - RNA, 22 nt, Artificial Sequence
  Synthetic
cugaggucucagcguagagaug

SEQ ID NO: 1385 - RNA, 22 nt, Artificial Sequence
  Synthetic
cuuagauggaggccgcgcagag

SEQ ID NO: 1386 - RNA, 22 nt, Artificial Sequence
  Synthetic
uucccccggggugguucuagcc

SEQ ID NO: 1387 - RNA, 22 nt, Artificial Sequence
  Synthetic
uuuucccccuccggcgcugggc

SEQ ID NO: 1388 - RNA, 20 nt, Artificial Sequence
  Synthetic
gaaagacugcagagggaucg

SEQ ID NO: 1389 - RNA, 20 nt, Artificial Sequence
  Synthetic
gagccaauagaauccggugg

SEQ ID NO: 1390 - RNA, 20 nt, Artificial Sequence
  Synthetic
gcacggacucgcacaggacc

SEQ ID NO: 1391 - RNA, 20 nt, Artificial Sequence
  Synthetic
gccggaagugcugcgagccc

SEQ ID NO: 1392 - RNA, 20 nt, Artificial Sequence
  Synthetic
gccggacgaacggaaggcgg

SEQ ID NO: 1393 - RNA, 20 nt, Artificial Sequence
  Synthetic
gccucuagcgcuggguguug

SEQ ID NO: 1394 - RNA, 20 nt, Artificial Sequence
  Synthetic
gcgcguggggggaauaggug

SEQ ID NO: 1395 - RNA, 20 nt, Artificial Sequence
  Synthetic
gcggguggagauuggcgccg

SEQ ID NO: 1396 - RNA, 20 nt, Artificial Sequence
  Synthetic
gcguccagaugcuagccucg

SEQ ID NO: 1397 - RNA, 20 nt, Artificial Sequence
  Synthetic
ggagaucccgggagagccgu

SEQ ID NO: 1398 - RNA, 20 nt, Artificial Sequence
  Synthetic
ggagccaauagaauccggug

SEQ ID NO: 1399 - RNA, 20 nt, Artificial Sequence
  Synthetic
ggccggacgaacggaaggcg

SEQ ID NO: 1400 - RNA, 20 nt, Artificial Sequence
  Synthetic
ggcgcugaaaccgugaggcc

SEQ ID NO: 1401 - RNA, 20 nt, Artificial Sequence
  Synthetic
ggcguccagaugcuagccuc

SEQ ID NO: 1402 - RNA, 20 nt, Artificial Sequence
  Synthetic
ggcuuugaaacuuaacaguu

SEQ ID NO: 1403 - RNA, 20 nt, Artificial Sequence
  Synthetic
gggagaucccgggagagccg

SEQ ID NO: 1404 - RNA, 20 nt, Artificial Sequence
  Synthetic
gggccggacgaacggaaggc

SEQ ID NO: 1405 - RNA, 20 nt, Artificial Sequence
  Synthetic
gggcguccagaugcuagccu

SEQ ID NO: 1406 - RNA, 20 nt, Artificial Sequence
  Synthetic
gguccugugcgaguccgugc

SEQ ID NO: 1407 - RNA, 20 nt, Artificial Sequence
  Synthetic
guuacagagccucuagcgcu

SEQ ID NO: 1408 - RNA, 20 nt, Artificial Sequence
  Synthetic
acggagccaauagaauccgg

SEQ ID NO: 1409 - RNA, 20 nt, Artificial Sequence
  Synthetic
agaucgcaggagauccaacu

SEQ ID NO: 1410 - RNA, 20 nt, Artificial Sequence
  Synthetic
agccucgggggccggacgaa

SEQ ID NO: 1411 - RNA, 20 nt, Artificial Sequence
  Synthetic
agccucuagcgcuggguguu

SEQ ID NO: 1412 - RNA, 20 nt, Artificial Sequence
  Synthetic
auagaauccggugggggcga

SEQ ID NO: 1413 - RNA, 20 nt, Artificial Sequence
  Synthetic
ccggagcuuacgguucagua

SEQ ID NO: 1414 - RNA, 20 nt, Artificial Sequence
  Synthetic
cggagccaauagaauccggu

SEQ ID NO: 1415 - RNA, 20 nt, Artificial Sequence
  Synthetic
cguccagaugcuagccucgg

SEQ ID NO: 1416 - RNA, 20 nt, Artificial Sequence
  Synthetic
cguuacagagccucuagcgc

SEQ ID NO: 1417 - RNA, 20 nt, Artificial Sequence
  Synthetic
cuacguucucaucccgcagc

SEQ ID NO: 1418 - RNA, 20 nt, Artificial Sequence
  Synthetic
cucacgguuucagcgccgcg

SEQ ID NO: 1419 - RNA, 20 nt, Artificial Sequence
  Synthetic
cucgcggcgcugaaaccgug

SEQ ID NO: 1420 - RNA, 20 nt, Artificial Sequence
  Synthetic
ucaccagcacggacucgcac

SEQ ID NO: 1421 - RNA, 20 nt, Artificial Sequence
  Synthetic
ucccccgccuuccguucguc

SEQ ID NO: 1422 - RNA, 20 nt, Artificial Sequence
  Synthetic
uccgagagcuccauagcguc

SEQ ID NO: 1423 - RNA, 20 nt, Artificial Sequence
  Synthetic
ucgcccccaccggauucuau

SEQ ID NO: 1424 - RNA, 20 nt, Artificial Sequence
  Synthetic
ucggcaaugauuggcuuccg

SEQ ID NO: 1425 - RNA, 20 nt, Artificial Sequence
  Synthetic
ucgggggccggacgaacgga

SEQ ID NO: 1426 - RNA, 20 nt, Artificial Sequence
  Synthetic
uggaggaccgcggaggucgu

SEQ ID NO: 1427 - RNA, 20 nt, Artificial Sequence
  Synthetic
uuccguucguccggcccccg

SEQ ID NO: 1428 - RNA, 22 nt, Artificial Sequence
  Synthetic
gaaacugaagccaagucaaugu

SEQ ID NO: 1429 - RNA, 22 nt, Artificial Sequence
  Synthetic
gaagcccuuccggacuccgggg

SEQ ID NO: 1430 - RNA, 22 nt, Artificial Sequence
  Synthetic
gacccccaucccacggcucucc

SEQ ID NO: 1431 - RNA, 22 nt, Artificial Sequence
  Synthetic
gaucccgggagagccgugggau

SEQ ID NO: 1432 - RNA, 22 nt, Artificial Sequence
  Synthetic
gcgccgcggaagccaaucauug

SEQ ID NO: 1433 - RNA, 22 nt, Artificial Sequence
  Synthetic
gcugacccagaaugggcagguc

SEQ ID NO: 1434 - RNA, 22 nt, Artificial Sequence
  Synthetic
ggaauagguguggaauaaauga

SEQ ID NO: 1435 - RNA, 22 nt, Artificial Sequence
  Synthetic
ggaccugacgcuauggagcucu

SEQ ID NO: 1436 - RNA, 22 nt, Artificial Sequence
  Synthetic
gggaagagaggaagcgcguggg

SEQ ID NO: 1437 - RNA, 22 nt, Artificial Sequence
  Synthetic
gggaugguggggacggagccaa

SEQ ID NO: 1438 - RNA, 22 nt, Artificial Sequence
  Synthetic
ggggccggacgaacggaaggcg

SEQ ID NO: 1439 - RNA, 22 nt, Artificial Sequence
  Synthetic
gggggagcgccugacucagccc

SEQ ID NO: 1440 - RNA, 22 nt, Artificial Sequence
  Synthetic
ggggggaauagguguggaauaa

SEQ ID NO: 1441 - RNA, 22 nt, Artificial Sequence
  Synthetic
aagcgcguggggggaauaggug

SEQ ID NO: 1442 - RNA, 22 nt, Artificial Sequence
  Synthetic
acaggugcgggaggcggagacu

SEQ ID NO: 1443 - RNA, 22 nt, Artificial Sequence
  Synthetic
agacacguucccagugcugacc

SEQ ID NO: 1444 - RNA, 22 nt, Artificial Sequence
  Synthetic
agccucaagggaaagacugcag

SEQ ID NO: 1445 - RNA, 22 nt, Artificial Sequence
  Synthetic
aucgcuccgccccucgccccca

SEQ ID NO: 1446 - RNA, 22 nt, Artificial Sequence
  Synthetic
augggagaucccgggagagccg

SEQ ID NO: 1447 - RNA, 22 nt, Artificial Sequence
  Synthetic
ccucucuggccccgcuccccag

SEQ ID NO: 1448 - RNA, 22 nt, Artificial Sequence
  Synthetic
cggaguuuugugggggacggcu

SEQ ID NO: 1449 - RNA, 22 nt, Artificial Sequence
  Synthetic
cucaguaaggagagacuuaagu

SEQ ID NO: 1450 - RNA, 22 nt, Artificial Sequence
  Synthetic
cuuacugagaggagggaccaag

SEQ ID NO: 1451 - RNA, 22 nt, Artificial Sequence
  Synthetic
cuuccucucuucccgguccugu

SEQ ID NO: 1452 - RNA, 22 nt, Artificial Sequence
  Synthetic
ucccaucccagaccugcccauu

SEQ ID NO: 1453 - RNA, 22 nt, Artificial Sequence
  Synthetic
uccgcgguccuccagaaccaua

SEQ ID NO: 1454 - RNA, 22 nt, Artificial Sequence
  Synthetic
ucuguucuccacugagcccugc

SEQ ID NO: 1455 - RNA, 22 nt, Artificial Sequence
  Synthetic
ugaagccaagucaaugucugag

SEQ ID NO: 1456 - RNA, 22 nt, Artificial Sequence
  Synthetic
uggcguuacagagccucuagcg

SEQ ID NO: 1457 - RNA, 22 nt, Artificial Sequence
  Synthetic
ugggaggagagagauguggccu

SEQ ID NO: 1458 - RNA, 22 nt, Artificial Sequence
  Synthetic
ugugagugggggguuccugcug

SEQ ID NO: 1459 - RNA, 22 nt, Artificial Sequence
  Synthetic
uuacugagcgcuucugugugcc

SEQ ID NO: 1460 - RNA, 22 nt, Artificial Sequence
  Synthetic
uugugggggacggcugugagug

SEQ ID NO: 1461 - RNA, 20 nt, Artificial Sequence
  Synthetic
gaagagcuuccauggaguca

SEQ ID NO: 1462 - RNA, 20 nt, Artificial Sequence
  Synthetic
gacuccauggaagcucuucc

SEQ ID NO: 1463 - RNA, 20 nt, Artificial Sequence
  Synthetic
gagagccgaguccgagagga

SEQ ID NO: 1464 - RNA, 20 nt, Artificial Sequence
  Synthetic
gauugccauggcgccgcugc

SEQ ID NO: 1465 - RNA, 20 nt, Artificial Sequence
  Synthetic
gccauggcaauccgucgagc

SEQ ID NO: 1466 - RNA, 20 nt, Artificial Sequence
  Synthetic
gccgacuccuaguggagagu

SEQ ID NO: 1467 - RNA, 20 nt, Artificial Sequence
  Synthetic
gccggcucgacggauugcca

SEQ ID NO: 1468 - RNA, 20 nt, Artificial Sequence
  Synthetic
gccuacucuccacuaggagu

SEQ ID NO: 1469 - RNA, 20 nt, Artificial Sequence
  Synthetic
gcgacccggaagagcuucca

SEQ ID NO: 1470 - RNA, 20 nt, Artificial Sequence
  Synthetic
gcuggaguacgagcgacagc

SEQ ID NO: 1471 - RNA, 20 nt, Artificial Sequence
  Synthetic
ggaagagcuuccauggaguc

SEQ ID NO: 1472 - RNA, 20 nt, Artificial Sequence
  Synthetic
ggcugccguccucucggacu

SEQ ID NO: 1473 - RNA, 20 nt, Artificial Sequence
  Synthetic
ggcugcguucggcugcgacc

SEQ ID NO: 1474 - RNA, 20 nt, Artificial Sequence
  Synthetic
guacgagcgacagcuggugc

SEQ ID NO: 1475 - RNA, 20 nt, Artificial Sequence
  Synthetic
guacuccagcagcggcgcca

SEQ ID NO: 1476 - RNA, 20 nt, Artificial Sequence
  Synthetic
agccggcugcccugacucca

SEQ ID NO: 1477 - RNA, 20 nt, Artificial Sequence
  Synthetic
agucagggcagccggcucga

SEQ ID NO: 1478 - RNA, 20 nt, Artificial Sequence
  Synthetic
aguucggccuacucuccacu

SEQ ID NO: 1479 - RNA, 20 nt, Artificial Sequence
  Synthetic
cacuaggagucggcuuccuu

SEQ ID NO: 1480 - RNA, 20 nt, Artificial Sequence
  Synthetic
cgaagagagccgaguccgag

SEQ ID NO: 1481 - RNA, 20 nt, Artificial Sequence
  Synthetic
cgaaggaagccgacuccuag

SEQ ID NO: 1482 - RNA, 20 nt, Artificial Sequence
  Synthetic
cggcucucuucgguugaguu

SEQ ID NO: 1483 - RNA, 20 nt, Artificial Sequence
  Synthetic
cggcuuccuucggcugcguu

SEQ ID NO: 1484 - RNA, 20 nt, Artificial Sequence
  Synthetic
cucucggacucggcucucuu

SEQ ID NO: 1485 - RNA, 20 nt, Artificial Sequence
  Synthetic
cuggaacugcucgacacuga

SEQ ID NO: 1486 - RNA, 20 nt, Artificial Sequence
  Synthetic
ucgcagccgaacgcagccga

SEQ ID NO: 1487 - RNA, 20 nt, Artificial Sequence
  Synthetic
ucggcuggcugccguccucu

SEQ ID NO: 1488 - RNA, 20 nt, Artificial Sequence
  Synthetic
ugacuccauggaagcucuuc

SEQ ID NO: 1489 - RNA, 20 nt, Artificial Sequence
  Synthetic
uggaacugcucgacacugac

SEQ ID NO: 1490 - RNA, 20 nt, Artificial Sequence
  Synthetic
ugucgcucguacuccagcag

SEQ ID NO: 1491 - RNA, 20 nt, Artificial Sequence
  Synthetic
uuccauggagucagggcagc

SEQ ID NO: 1492 - RNA, 22 nt, Artificial Sequence
  Synthetic
ggccgaacucaaccgaagagag

SEQ ID NO: 1493 - RNA, 22 nt, Artificial Sequence
  Synthetic
cccugacuccauggaagcucuu

SEQ ID NO: 1494 - RNA, 22 nt, Artificial Sequence
  Synthetic
cgaaggaagccgacuccuagug

SEQ ID NO: 1495 - RNA, 22 nt, Artificial Sequence
  Synthetic
cggauugccauggcgccgcugc

SEQ ID NO: 1496 - RNA, 22 nt, Artificial Sequence
  Synthetic
cugcgacccggaagagcuucca

SEQ ID NO: 1497 - RNA, 22 nt, Artificial Sequence
  Synthetic
ucucggacucggcucucuucgg

SEQ ID NO: 1498 - RNA, 22 nt, Artificial Sequence
  Synthetic
ugaguucggccuacucuccacu

SEQ ID NO: 1499 - RNA, 22 nt, Artificial Sequence
  Synthetic
uggagucagggcagccggcucg

SEQ ID NO: 1500 - RNA, 20 nt, Artificial Sequence
  Synthetic
gaacccgcguccacggggcg

SEQ ID NO: 1501 - RNA, 20 nt, Artificial Sequence
  Synthetic
gauugcugaugccuggccgc

SEQ ID NO: 1502 - RNA, 20 nt, Artificial Sequence
  Synthetic
gcagggggcgcgcgcgccgc

SEQ ID NO: 1503 - RNA, 20 nt, Artificial Sequence
  Synthetic
gcccacggaacccgcgucca

SEQ ID NO: 1504 - RNA, 20 nt, Artificial Sequence
  Synthetic
gcccccugccggccgggggg

SEQ ID NO: 1505 - RNA, 20 nt, Artificial Sequence
  Synthetic
gccgcucaggcgccugcggc

SEQ ID NO: 1506 - RNA, 20 nt, Artificial Sequence
  Synthetic
gcgcacgcgaggcggcgagg

SEQ ID NO: 1507 - RNA, 20 nt, Artificial Sequence
  Synthetic
gcgccgccggccccgccccg

SEQ ID NO: 1508 - RNA, 20 nt, Artificial Sequence
  Synthetic
gcgcgcccccugccggccgg

SEQ ID NO: 1509 - RNA, 20 nt, Artificial Sequence
  Synthetic
gcgcgcgcccccugccggcc

SEQ ID NO: 1510 - RNA, 20 nt, Artificial Sequence
  Synthetic
gcggcgcgcgcgcccccugc

SEQ ID NO: 1511 - RNA, 20 nt, Artificial Sequence
  Synthetic
gcgugcgcucacccagccgc

SEQ ID NO: 1512 - RNA, 20 nt, Artificial Sequence
  Synthetic
ggaacccgcguccacggggc

SEQ ID NO: 1513 - RNA, 20 nt, Artificial Sequence
  Synthetic
ggcagcguguuucuaggucg

SEQ ID NO: 1514 - RNA, 20 nt, Artificial Sequence
  Synthetic
ggccggugcggcguguucgg

SEQ ID NO: 1515 - RNA, 20 nt, Artificial Sequence
  Synthetic
ggcguguucgguggcggcuc

SEQ ID NO: 1516 - RNA, 20 nt, Artificial Sequence
  Synthetic
gggaacggcgguggccggug

SEQ ID NO: 1517 - RNA, 20 nt, Artificial Sequence
  Synthetic
ggguuccgugggcguucccg

SEQ ID NO: 1518 - RNA, 20 nt, Artificial Sequence
  Synthetic
gguggccggugcggcguguu

SEQ ID NO: 1519 - RNA, 20 nt, Artificial Sequence
  Synthetic
gguggcggcucuggccgcuc

SEQ ID NO: 1520 - RNA, 20 nt, Artificial Sequence
  Synthetic
aacuccgccccccggccggc

SEQ ID NO: 1521 - RNA, 20 nt, Artificial Sequence
  Synthetic
aaucuaucagggaacggcgg

SEQ ID NO: 1522 - RNA, 20 nt, Artificial Sequence
  Synthetic
acuccgccccccggccggca

SEQ ID NO: 1523 - RNA, 20 nt, Artificial Sequence
  Synthetic
agcaaucuaucagggaacgg

SEQ ID NO: 1524 - RNA, 20 nt, Artificial Sequence
  Synthetic
ccacggaacccgcguccacg

SEQ ID NO: 1525 - RNA, 20 nt, Artificial Sequence
  Synthetic
cccacggaacccgcguccac

SEQ ID NO: 1526 - RNA, 20 nt, Artificial Sequence
  Synthetic
ccccguggacgcggguuccg

SEQ ID NO: 1527 - RNA, 20 nt, Artificial Sequence
  Synthetic
cccguggacgcggguuccgu

SEQ ID NO: 1528 - RNA, 20 nt, Artificial Sequence
  Synthetic
ccgcucaggcgccugcggcu

SEQ ID NO: 1529 - RNA, 20 nt, Artificial Sequence
  Synthetic
ccgugggcguucccgcggcc

SEQ ID NO: 1530 - RNA, 20 nt, Artificial Sequence
  Synthetic
ccugauagauugcugaugcc

SEQ ID NO: 1531 - RNA, 20 nt, Artificial Sequence
  Synthetic
ccuggccgcgggaacgccca

SEQ ID NO: 1532 - RNA, 20 nt, Artificial Sequence
  Synthetic
cgaggcggcagcguguuucu

SEQ ID NO: 1533 - RNA, 20 nt, Artificial Sequence
  Synthetic
cgccaccgaacacgccgcac

SEQ ID NO: 1534 - RNA, 20 nt, Artificial Sequence
  Synthetic
cggaacccgcguccacgggg

SEQ ID NO: 1535 - RNA, 20 nt, Artificial Sequence
  Synthetic
cggcugggugagcgcacgcg

SEQ ID NO: 1536 - RNA, 20 nt, Artificial Sequence
  Synthetic
cggugcggcguguucggugg

SEQ ID NO: 1537 - RNA, 20 nt, Artificial Sequence
  Synthetic
cugggugagcgcacgcgagg

SEQ ID NO: 1538 - RNA, 20 nt, Artificial Sequence
  Synthetic
uaucagggaacggcgguggc

SEQ ID NO: 1539 - RNA, 20 nt, Artificial Sequence
  Synthetic
ugagcgcacgcgaggcggcg

SEQ ID NO: 1540 - RNA, 22 nt, Artificial Sequence
  Synthetic
gcgcccccugccggccgggggg

SEQ ID NO: 1541 - RNA, 22 nt, Artificial Sequence
  Synthetic
ccgccggccccgccccguggac

SEQ ID NO: 1542 - RNA, 22 nt, Artificial Sequence
  Synthetic
cuggccgcucaggcgccugcgg

SEQ ID NO: 1543 - RNA, 20 nt, Artificial Sequence
  Synthetic
gaaagagccaagcgucucuc

SEQ ID NO: 1544 - RNA, 20 nt, Artificial Sequence
  Synthetic
gaggccuucacccucugcuc

SEQ ID NO: 1545 - RNA, 20 nt, Artificial Sequence
  Synthetic
gagucccgggaaagggacag

SEQ ID NO: 1546 - RNA, 20 nt, Artificial Sequence
  Synthetic
gaugcucugggguacuggcg

SEQ ID NO: 1547 - RNA, 20 nt, Artificial Sequence
  Synthetic
gcucgcugagacuuccugga

SEQ ID NO: 1548 - RNA, 20 nt, Artificial Sequence
  Synthetic
gcugcuuagcgguagccccu

SEQ ID NO: 1549 - RNA, 20 nt, Artificial Sequence
  Synthetic
gggcccccugucccuuuccc

SEQ ID NO: 1550 - RNA, 20 nt, Artificial Sequence
  Synthetic
ggggcccaagugaugcucug

SEQ ID NO: 1551 - RNA, 20 nt, Artificial Sequence
  Synthetic
gggggcccaagugaugcucu

SEQ ID NO: 1552 - RNA, 20 nt, Artificial Sequence
  Synthetic
gggguacuggcgugggagag

SEQ ID NO: 1553 - RNA, 20 nt, Artificial Sequence
  Synthetic
ggguaaagguaguagagucc

SEQ ID NO: 1554 - RNA, 20 nt, Artificial Sequence
  Synthetic
gguaaagguaguagaguccc

SEQ ID NO: 1555 - RNA, 20 nt, Artificial Sequence
  Synthetic
gguacaaucagaggauggga

SEQ ID NO: 1556 - RNA, 20 nt, Artificial Sequence
  Synthetic
gguaguagagucccgggaaa

SEQ ID NO: 1557 - RNA, 20 nt, Artificial Sequence
  Synthetic
ggugaaggccuccugagcgc

SEQ ID NO: 1558 - RNA, 20 nt, Artificial Sequence
  Synthetic
gugaaggccuccugagcgca

SEQ ID NO: 1559 - RNA, 20 nt, Artificial Sequence
  Synthetic
gugagcucgcugagacuucc

SEQ ID NO: 1560 - RNA, 20 nt, Artificial Sequence
  Synthetic
gugggguuucucagauaacu

SEQ ID NO: 1561 - RNA, 20 nt, Artificial Sequence
  Synthetic
aaagagccaagcgucucucg

SEQ ID NO: 1562 - RNA, 20 nt, Artificial Sequence
  Synthetic
aaauuaaaacugcgacugcg

SEQ ID NO: 1563 - RNA, 20 nt, Artificial Sequence
  Synthetic
acgucauccgggggcagacu

SEQ ID NO: 1564 - RNA, 20 nt, Artificial Sequence
  Synthetic
ccaagcgucucucggggcuc

SEQ ID NO: 1565 - RNA, 20 nt, Artificial Sequence
  Synthetic
ccccuugguuuccguggcaa

SEQ ID NO: 1566 - RNA, 20 nt, Artificial Sequence
  Synthetic
cccgcgcuuuuccguugcca

SEQ ID NO: 1567 - RNA, 20 nt, Artificial Sequence
  Synthetic
ccguggcaacggaaaagcgc

SEQ ID NO: 1568 - RNA, 20 nt, Artificial Sequence
  Synthetic
ccguugccacggaaaccaag

SEQ ID NO: 1569 - RNA, 20 nt, Artificial Sequence
  Synthetic
ccucucagaauacgaaauca

SEQ ID NO: 1570 - RNA, 20 nt, Artificial Sequence
  Synthetic
cgaaaucaagguacaaucag

SEQ ID NO: 1571 - RNA, 20 nt, Artificial Sequence
  Synthetic
cgguagccccuugguuuccg

SEQ ID NO: 1572 - RNA, 20 nt, Artificial Sequence
  Synthetic
cugcccccggaugacguaaa

SEQ ID NO: 1573 - RNA, 20 nt, Artificial Sequence
  Synthetic
cuuuccuuuuacgucauccg

SEQ ID NO: 1574 - RNA, 20 nt, Artificial Sequence
  Synthetic
uacgucauccgggggcagac

SEQ ID NO: 1575 - RNA, 20 nt, Artificial Sequence
  Synthetic
ucauccgggggcagacuggg

SEQ ID NO: 1576 - RNA, 20 nt, Artificial Sequence
  Synthetic
uccguggcaacggaaaagcg

SEQ ID NO: 1577 - RNA, 20 nt, Artificial Sequence
  Synthetic
uccguugccacggaaaccaa

SEQ ID NO: 1578 - RNA, 20 nt, Artificial Sequence
  Synthetic
ucuuuccuuuuacgucaucc

SEQ ID NO: 1579 - RNA, 20 nt, Artificial Sequence
  Synthetic
uuccguugccacggaaacca

SEQ ID NO: 1580 - RNA, 20 nt, Artificial Sequence
  Synthetic
uuuccuuuuacgucauccgg

SEQ ID NO: 1581 - RNA, 22 nt, Artificial Sequence
  Synthetic
gagccaagcgucucucggggcu

SEQ ID NO: 1582 - RNA, 22 nt, Artificial Sequence
  Synthetic
ggauuggccacccagucugccc

SEQ ID NO: 1583 - RNA, 22 nt, Artificial Sequence
  Synthetic
aaaaggaaagagacggaagagg

SEQ ID NO: 1584 - RNA, 22 nt, Artificial Sequence
  Synthetic
acagggggcccaagugaugcuc

SEQ ID NO: 1585 - RNA, 22 nt, Artificial Sequence
  Synthetic
auacgaaaucaagguacaauca

SEQ ID NO: 1586 - RNA, 22 nt, Artificial Sequence
  Synthetic
augcucugggguacuggcgugg

SEQ ID NO: 1587 - RNA, 22 nt, Artificial Sequence
  Synthetic
caggaggccuucacccucugcu

SEQ ID NO: 1588 - RNA, 22 nt, Artificial Sequence
  Synthetic
ccucugcucuggguaaagguag

SEQ ID NO: 1589 - RNA, 22 nt, Artificial Sequence
  Synthetic
cuaccgcuaagcagcagccucu

SEQ ID NO: 1590 - RNA, 22 nt, Artificial Sequence
  Synthetic
ucuacuaccuuuacccagagca

SEQ ID NO: 1591 - RNA, 22 nt, Artificial Sequence
  Synthetic
ucugggguacuggcgugggaga

SEQ ID NO: 1592 - RNA, 22 nt, Artificial Sequence
  Synthetic
uuccguggcaacggaaaagcgc

SEQ ID NO: 1593 - RNA, 22 nt, Artificial Sequence
  Synthetic
uuccuggacgggggacaggcug

SEQ ID NO: 1594 - RNA, 22 nt, Artificial Sequence
  Synthetic
uuuuacgucauccgggggcaga

SEQ ID NO: 1595 - RNA, 20 nt, Artificial Sequence
  Synthetic
gaaucccgaggcaaucucgg

SEQ ID NO: 1596 - RNA, 20 nt, Artificial Sequence
  Synthetic
gacagcccgcgcuuuaaggc

SEQ ID NO: 1597 - RNA, 20 nt, Artificial Sequence
  Synthetic
gagcccgcgcgacgucacgc

SEQ ID NO: 1598 - RNA, 20 nt, Artificial Sequence
  Synthetic
gaggagcgggcucuucggug

SEQ ID NO: 1599 - RNA, 20 nt, Artificial Sequence
  Synthetic
gauucgcgaaagcccccgaa

SEQ ID NO: 1600 - RNA, 20 nt, Artificial Sequence
  Synthetic
gccagacccgcacgcggaac

SEQ ID NO: 1601 - RNA, 20 nt, Artificial Sequence
  Synthetic
gcccgcgccgguuccgcgug

SEQ ID NO: 1602 - RNA, 20 nt, Artificial Sequence
  Synthetic
gcccgggcuacacucggugg

SEQ ID NO: 1603 - RNA, 20 nt, Artificial Sequence
  Synthetic
gccgguuccgcgugcggguc

SEQ ID NO: 1604 - RNA, 20 nt, Artificial Sequence
  Synthetic
gccuuaaagcgcgggcuguc

SEQ ID NO: 1605 - RNA, 20 nt, Artificial Sequence
  Synthetic
gcuuuaaggccgggggcugc

SEQ ID NO: 1606 - RNA, 20 nt, Artificial Sequence
  Synthetic
ggagcccgcgcgacgucacg

SEQ ID NO: 1607 - RNA, 20 nt, Artificial Sequence
  Synthetic
ggauucgcgaaagcccccga

SEQ ID NO: 1608 - RNA, 20 nt, Artificial Sequence
  Synthetic
ggcgaagggcucccggggua

SEQ ID NO: 1609 - RNA, 20 nt, Artificial Sequence
  Synthetic
ggcucgcgcgcgcgcuucgg

SEQ ID NO: 1610 - RNA, 20 nt, Artificial Sequence
  Synthetic
ggggcgggcuuggcggcgaa

SEQ ID NO: 1611 - RNA, 20 nt, Artificial Sequence
  Synthetic
gggggcuuucgcgaaucccg

SEQ ID NO: 1612 - RNA, 20 nt, Artificial Sequence
  Synthetic
gguagcgcucguccucccgc

SEQ ID NO: 1613 - RNA, 20 nt, Artificial Sequence
  Synthetic
gucgcuccgacccagagcuc

SEQ ID NO: 1614 - RNA, 20 nt, Artificial Sequence
  Synthetic
gugcuuggcgaagggcuccc

SEQ ID NO: 1615 - RNA, 20 nt, Artificial Sequence
  Synthetic
aacucccgcgugacgucgcg

SEQ ID NO: 1616 - RNA, 20 nt, Artificial Sequence
  Synthetic
acccgcacgcggaaccggcg

SEQ ID NO: 1617 - RNA, 20 nt, Artificial Sequence
  Synthetic
accgccuccgagauugccuc

SEQ ID NO: 1618 - RNA, 20 nt, Artificial Sequence
  Synthetic
acgaagugcgccgccgcgau

SEQ ID NO: 1619 - RNA, 20 nt, Artificial Sequence
  Synthetic
acgucgcgcgggcucccggg

SEQ ID NO: 1620 - RNA, 20 nt, Artificial Sequence
  Synthetic
acucccgcgugacgucgcgc

SEQ ID NO: 1621 - RNA, 20 nt, Artificial Sequence
  Synthetic
agcccgcgcuuuaaggccgg

SEQ ID NO: 1622 - RNA, 20 nt, Artificial Sequence
  Synthetic
caaccaucgcccuccgggau

SEQ ID NO: 1623 - RNA, 20 nt, Artificial Sequence
  Synthetic
cacgaagugcgccgccgcga

SEQ ID NO: 1624 - RNA, 20 nt, Artificial Sequence
  Synthetic
caucccggagggcgaugguu

SEQ ID NO: 1625 - RNA, 20 nt, Artificial Sequence
  Synthetic
cccgcgccgguuccgcgugc

SEQ ID NO: 1626 - RNA, 20 nt, Artificial Sequence
  Synthetic
cgcgaaucccgaggcaaucu

SEQ ID NO: 1627 - RNA, 20 nt, Artificial Sequence
  Synthetic
cgcgcgcuucggagguuuuu

SEQ ID NO: 1628 - RNA, 20 nt, Artificial Sequence
  Synthetic
cgggcccgggcuacacucgg

SEQ ID NO: 1629 - RNA, 20 nt, Artificial Sequence
  Synthetic
cgugacgucgcgcgggcucc

SEQ ID NO: 1630 - RNA, 20 nt, Artificial Sequence
  Synthetic
uaaagcgcgggcuguccgga

SEQ ID NO: 1631 - RNA, 20 nt, Artificial Sequence
  Synthetic
ucccgaggcaaucucggagg

SEQ ID NO: 1632 - RNA, 20 nt, Artificial Sequence
  Synthetic
uccggacagcccgcgcuuua

SEQ ID NO: 1633 - RNA, 20 nt, Artificial Sequence
  Synthetic
ucggugcggcccaucccgga

SEQ ID NO: 1634 - RNA, 20 nt, Artificial Sequence
  Synthetic
uuaaagcgcgggcuguccgg

SEQ ID NO: 1635 - RNA, 22 nt, Artificial Sequence
  Synthetic
gagcgcuaccucaguacuacuu

SEQ ID NO: 1636 - RNA, 22 nt, Artificial Sequence
  Synthetic
gcagucgcuccgacccagagcu

SEQ ID NO: 1637 - RNA, 22 nt, Artificial Sequence
  Synthetic
gggagcccgcgcgacgucacgc

SEQ ID NO: 1638 - RNA, 22 nt, Artificial Sequence
  Synthetic
ggguagggguggcucccggcuc

SEQ ID NO: 1639 - RNA, 22 nt, Artificial Sequence
  Synthetic
ggugcccgcgccgguuccgcgu

SEQ ID NO: 1640 - RNA, 22 nt, Artificial Sequence
  Synthetic
gucgcgcgggcucccgggcggg

SEQ ID NO: 1641 - RNA, 22 nt, Artificial Sequence
  Synthetic
ccuuaaagcgcgggcuguccgg

SEQ ID NO: 1642 - RNA, 22 nt, Artificial Sequence
  Synthetic
cgcuccgacccagagcuccggg

SEQ ID NO: 1643 - RNA, 22 nt, Artificial Sequence
  Synthetic
cggaggggucggcuuucccacc

SEQ ID NO: 1644 - RNA, 22 nt, Artificial Sequence
  Synthetic
cggcgcgggcaccuggggagaa

SEQ ID NO: 1645 - RNA, 22 nt, Artificial Sequence
  Synthetic
cucaccgccuccgagauugccu

SEQ ID NO: 1646 - RNA, 22 nt, Artificial Sequence
  Synthetic
cucuuucgcccuuuucccucac

SEQ ID NO: 1647 - RNA, 22 nt, Artificial Sequence
  Synthetic
cuuggcgaagggcucccggggu

SEQ ID NO: 1648 - RNA, 22 nt, Artificial Sequence
  Synthetic
ucccgaggcaaucucggaggcg

SEQ ID NO: 1649 - RNA, 22 nt, Artificial Sequence
  Synthetic
uccucccgccgguccaccacca

SEQ ID NO: 1650 - RNA, 22 nt, Artificial Sequence
  Synthetic
ucgcuucccuucgggggcuuuc

SEQ ID NO: 1651 - RNA, 22 nt, Artificial Sequence
  Synthetic
ucucuuuaccccacccggagcu

SEQ ID NO: 1652 - RNA, 22 nt, Artificial Sequence
  Synthetic
ugcgugcuuggcgaagggcucc

SEQ ID NO: 1653 - RNA, 20 nt, Artificial Sequence
  Synthetic
gacgcgcaggucgaccccca

SEQ ID NO: 1654 - RNA, 20 nt, Artificial Sequence
  Synthetic
gacgucacauccucugggcg

SEQ ID NO: 1655 - RNA, 20 nt, Artificial Sequence
  Synthetic
gagagcagacgauuccgggc

SEQ ID NO: 1656 - RNA, 20 nt, Artificial Sequence
  Synthetic
gaggagagucccuucucgga

SEQ ID NO: 1657 - RNA, 20 nt, Artificial Sequence
  Synthetic
gagggucggaggugacgcgc

SEQ ID NO: 1658 - RNA, 20 nt, Artificial Sequence
  Synthetic
gauaagagagcagacgauuc

SEQ ID NO: 1659 - RNA, 20 nt, Artificial Sequence
  Synthetic
gcacaucuccgcgagacaga

SEQ ID NO: 1660 - RNA, 20 nt, Artificial Sequence
  Synthetic
gccuaaggaaacgugucguc

SEQ ID NO: 1661 - RNA, 20 nt, Artificial Sequence
  Synthetic
gcggaaaaaugagguaaguc

SEQ ID NO: 1662 - RNA, 20 nt, Artificial Sequence
  Synthetic
gcgggcugugcggaggcuaa

SEQ ID NO: 1663 - RNA, 20 nt, Artificial Sequence
  Synthetic
gcguugacgucacauccucu

SEQ ID NO: 1664 - RNA, 20 nt, Artificial Sequence
  Synthetic
gcuaauggguggguucccuu

SEQ ID NO: 1665 - RNA, 20 nt, Artificial Sequence
  Synthetic
gcugaccuuucaauuugcgc

SEQ ID NO: 1666 - RNA, 20 nt, Artificial Sequence
  Synthetic
ggaaacgugucgucuggaau

SEQ ID NO: 1667 - RNA, 20 nt, Artificial Sequence
  Synthetic
ggcuaauggguggguucccu

SEQ ID NO: 1668 - RNA, 20 nt, Artificial Sequence
  Synthetic
ggcugaccuuucaauuugcg

SEQ ID NO: 1669 - RNA, 20 nt, Artificial Sequence
  Synthetic
gggauucgggucuuccagga

SEQ ID NO: 1670 - RNA, 20 nt, Artificial Sequence
  Synthetic
gugaguuaggggcgucggag

SEQ ID NO: 1671 - RNA, 20 nt, Artificial Sequence
  Synthetic
guguucugcguugccggccg

SEQ ID NO: 1672 - RNA, 20 nt, Artificial Sequence
  Synthetic
guugccggccgugggugcuc

SEQ ID NO: 1673 - RNA, 20 nt, Artificial Sequence
  Synthetic
aaucggcuccgcucaagggg

SEQ ID NO: 1674 - RNA, 20 nt, Artificial Sequence
  Synthetic
accgcaaucggcuccgcuca

SEQ ID NO: 1675 - RNA, 20 nt, Artificial Sequence
  Synthetic
acgcgcaggucgacccccaa

SEQ ID NO: 1676 - RNA, 20 nt, Artificial Sequence
  Synthetic
acggccggcaacgcagaaca

SEQ ID NO: 1677 - RNA, 20 nt, Artificial Sequence
  Synthetic
aggaacccgcgcaaauugaa

SEQ ID NO: 1678 - RNA, 20 nt, Artificial Sequence
  Synthetic
cagccuuucgcgcgcugugu

SEQ ID NO: 1679 - RNA, 20 nt, Artificial Sequence
  Synthetic
ccgacccuccucucgggauu

SEQ ID NO: 1680 - RNA, 20 nt, Artificial Sequence
  Synthetic
ccgcaaucggcuccgcucaa

SEQ ID NO: 1681 - RNA, 20 nt, Artificial Sequence
  Synthetic
cgcaaucggcuccgcucaag

SEQ ID NO: 1682 - RNA, 20 nt, Artificial Sequence
  Synthetic
cgcguugacgucacauccuc

SEQ ID NO: 1683 - RNA, 20 nt, Artificial Sequence
  Synthetic
cggccggcaacgcagaacac

SEQ ID NO: 1684 - RNA, 20 nt, Artificial Sequence
  Synthetic
cggguuucuccaaccgcaau

SEQ ID NO: 1685 - RNA, 20 nt, Artificial Sequence
  Synthetic
cucgcggagaugugcaggcg

SEQ ID NO: 1686 - RNA, 20 nt, Artificial Sequence
  Synthetic
ucaacgcguaucccgcaacc

SEQ ID NO: 1687 - RNA, 20 nt, Artificial Sequence
  Synthetic
ucucgggauucgggucuucc

SEQ ID NO: 1688 - RNA, 20 nt, Artificial Sequence
  Synthetic
ugagcggagccgauugcggu

SEQ ID NO: 1689 - RNA, 20 nt, Artificial Sequence
  Synthetic
uggaagacccgaaucccgag

SEQ ID NO: 1690 - RNA, 20 nt, Artificial Sequence
  Synthetic
uguucugcguugccggccgu

SEQ ID NO: 1691 - RNA, 20 nt, Artificial Sequence
  Synthetic
uuacccguguucugcguugc

SEQ ID NO: 1692 - RNA, 20 nt, Artificial Sequence
  Synthetic
uugccuacacagcgcgcgaa

SEQ ID NO: 1693 - RNA, 22 nt, Artificial Sequence
  Synthetic
gauuccgggcuggagcaggcgc

SEQ ID NO: 1694 - RNA, 22 nt, Artificial Sequence
  Synthetic
gccuccugcggcuuccaacuca

SEQ ID NO: 1695 - RNA, 22 nt, Artificial Sequence
  Synthetic
gcgucaccuccgacccuccucu

SEQ ID NO: 1696 - RNA, 22 nt, Artificial Sequence
  Synthetic
ggagagcucaggacgcaacccu

SEQ ID NO: 1697 - RNA, 22 nt, Artificial Sequence
  Synthetic
ggagcgggcugugcggaggcua

SEQ ID NO: 1698 - RNA, 22 nt, Artificial Sequence
  Synthetic
ggccgugggugcucuggccaca

SEQ ID NO: 1699 - RNA, 22 nt, Artificial Sequence
  Synthetic
gggucuuccaggaagggaagga

SEQ ID NO: 1700 - RNA, 22 nt, Artificial Sequence
  Synthetic
ggguuccuugcggccccgccca

SEQ ID NO: 1701 - RNA, 22 nt, Artificial Sequence
  Synthetic
aaaggcugaccuuucaauuugc

SEQ ID NO: 1702 - RNA, 22 nt, Artificial Sequence
  Synthetic
aacccuggcgccugcuccagcc

SEQ ID NO: 1703 - RNA, 22 nt, Artificial Sequence
  Synthetic
acagcggagcccuuagccugag

SEQ ID NO: 1704 - RNA, 22 nt, Artificial Sequence
  Synthetic
acagugaguuaggggcgucgga

SEQ ID NO: 1705 - RNA, 22 nt, Artificial Sequence
  Synthetic
acccaacagcggagcccuuagc

SEQ ID NO: 1706 - RNA, 22 nt, Artificial Sequence
  Synthetic
acucaggcuaagggcuccgcug

SEQ ID NO: 1707 - RNA, 22 nt, Artificial Sequence
  Synthetic
aggccuaaggaaacgugucguc

SEQ ID NO: 1708 - RNA, 22 nt, Artificial Sequence
  Synthetic
aggcuaauggguggguucccuu

SEQ ID NO: 1709 - RNA, 22 nt, Artificial Sequence
  Synthetic
cccacggccggcaacgcagaac

SEQ ID NO: 1710 - RNA, 22 nt, Artificial Sequence
  Synthetic
cccguguucugcguugccggcc

SEQ ID NO: 1711 - RNA, 22 nt, Artificial Sequence
  Synthetic
ccuccgacccuccucucgggau

SEQ ID NO: 1712 - RNA, 22 nt, Artificial Sequence
  Synthetic
ccugcacaucuccgcgagacag

SEQ ID NO: 1713 - RNA, 22 nt, Artificial Sequence
  Synthetic
cgcaggaggcggaaccggguug

SEQ ID NO: 1714 - RNA, 22 nt, Artificial Sequence
  Synthetic
cggcuccgcucaaggggaggag

SEQ ID NO: 1715 - RNA, 22 nt, Artificial Sequence
  Synthetic
cgggcugugcggaggcuaaugg

SEQ ID NO: 1716 - RNA, 22 nt, Artificial Sequence
  Synthetic
ucuccuucccuuccuggaagac

SEQ ID NO: 1717 - RNA, 22 nt, Artificial Sequence
  Synthetic
uggaagacccgaaucccgagag

SEQ ID NO: 1718 - RNA, 22 nt, Artificial Sequence
  Synthetic
uuggaagccgcaggaggcggaa

SEQ ID NO: 1719 - RNA, 20 nt, Artificial Sequence
  Synthetic
gaacgaacuggagcugcuga

SEQ ID NO: 1720 - RNA, 20 nt, Artificial Sequence
  Synthetic
gaagaguuuuugggaggagg

SEQ ID NO: 1721 - RNA, 20 nt, Artificial Sequence
  Synthetic
gacagaaaagacagcggaac

SEQ ID NO: 1722 - RNA, 20 nt, Artificial Sequence
  Synthetic
gagcccugcugcucagguga

SEQ ID NO: 1723 - RNA, 20 nt, Artificial Sequence
  Synthetic
gauggagaagaguuuuuggg

SEQ ID NO: 1724 - RNA, 20 nt, Artificial Sequence
  Synthetic
gauggagcagcugaacgaac

SEQ ID NO: 1725 - RNA, 20 nt, Artificial Sequence
  Synthetic
gcgccggcgcguuccacgug

SEQ ID NO: 1726 - RNA, 20 nt, Artificial Sequence
  Synthetic
gcggccuggcgcaggucauu

SEQ ID NO: 1727 - RNA, 20 nt, Artificial Sequence
  Synthetic
gcugauggagaagaguuuuu

SEQ ID NO: 1728 - RNA, 20 nt, Artificial Sequence
  Synthetic
gcugccggcggagcugugag

SEQ ID NO: 1729 - RNA, 20 nt, Artificial Sequence
  Synthetic
gcugcuccauccuggacgcg

SEQ ID NO: 1730 - RNA, 20 nt, Artificial Sequence
  Synthetic
ggaacgcgccggcgcgggag

SEQ ID NO: 1731 - RNA, 20 nt, Artificial Sequence
  Synthetic
ggagaagaguuuuugggagg

SEQ ID NO: 1732 - RNA, 20 nt, Artificial Sequence
  Synthetic
gggacagagcccugcugcuc

SEQ ID NO: 1733 - RNA, 20 nt, Artificial Sequence
  Synthetic
gggagguuucggacacgggu

SEQ ID NO: 1734 - RNA, 20 nt, Artificial Sequence
  Synthetic
gggccccacguggaacgcgc

SEQ ID NO: 1735 - RNA, 20 nt, Artificial Sequence
  Synthetic
gggccccucaccugagcagc

SEQ ID NO: 1736 - RNA, 20 nt, Artificial Sequence
  Synthetic
gguuggagugucaagagaga

SEQ ID NO: 1737 - RNA, 20 nt, Artificial Sequence
  Synthetic
guauucccaguccuaagcaa

SEQ ID NO: 1738 - RNA, 20 nt, Artificial Sequence
  Synthetic
guggaacgcgccggcgcggg

SEQ ID NO: 1739 - RNA, 20 nt, Artificial Sequence
  Synthetic
aacccgggagguuucggaca

SEQ ID NO: 1740 - RNA, 20 nt, Artificial Sequence
  Synthetic
aacccguguccgaaaccucc

SEQ ID NO: 1741 - RNA, 20 nt, Artificial Sequence
  Synthetic
acagaaaagacagcggaacc

SEQ ID NO: 1742 - RNA, 20 nt, Artificial Sequence
  Synthetic
acccgggagguuucggacac

SEQ ID NO: 1743 - RNA, 20 nt, Artificial Sequence
  Synthetic
acccguguccgaaaccuccc

SEQ ID NO: 1744 - RNA, 20 nt, Artificial Sequence
  Synthetic
agaaaagacagcggaaccgg

SEQ ID NO: 1745 - RNA, 20 nt, Artificial Sequence
  Synthetic
aguccuaagcaagggagcaa

SEQ ID NO: 1746 - RNA, 20 nt, Artificial Sequence
  Synthetic
aguuugcgauccccgcgucc

SEQ ID NO: 1747 - RNA, 20 nt, Artificial Sequence
  Synthetic
cacguggaacgcgccggcgc

SEQ ID NO: 1748 - RNA, 20 nt, Artificial Sequence
  Synthetic
cagaaaagacagcggaaccg

SEQ ID NO: 1749 - RNA, 20 nt, Artificial Sequence
  Synthetic
ccacguggaacgcgccggcg

SEQ ID NO: 1750 - RNA, 20 nt, Artificial Sequence
  Synthetic
ccgcgccggcgcguuccacg

SEQ ID NO: 1751 - RNA, 20 nt, Artificial Sequence
  Synthetic
cgcaugcgcgcgaggugcgc

SEQ ID NO: 1752 - RNA, 20 nt, Artificial Sequence
  Synthetic
cgcgccggcgcguuccacgu

SEQ ID NO: 1753 - RNA, 20 nt, Artificial Sequence
  Synthetic
cggccuggcgcaggucauuu

SEQ ID NO: 1754 - RNA, 20 nt, Artificial Sequence
  Synthetic
ugcgauccccgcguccagga

SEQ ID NO: 1755 - RNA, 20 nt, Artificial Sequence
  Synthetic
uggaacgcgccggcgcggga

SEQ ID NO: 1756 - RNA, 20 nt, Artificial Sequence
  Synthetic
ugucccaaaugaccugcgcc

SEQ ID NO: 1757 - RNA, 20 nt, Artificial Sequence
  Synthetic
uucguucagcugcuccaucc

SEQ ID NO: 1758 - RNA, 20 nt, Artificial Sequence
  Synthetic
uugcucccuugcuuaggacu

SEQ ID NO: 1759 - RNA, 22 nt, Artificial Sequence
  Synthetic
gcgcaggucauuugggacaucu

SEQ ID NO: 1760 - RNA, 22 nt, Artificial Sequence
  Synthetic
gugaacccgggagguuucggac

SEQ ID NO: 1761 - RNA, 22 nt, Artificial Sequence
  Synthetic
agacagaaaagacagcggaacc

SEQ ID NO: 1762 - RNA, 22 nt, Artificial Sequence
  Synthetic
ccgggagguuucggacacgggu

SEQ ID NO: 1763 - RNA, 22 nt, Artificial Sequence
  Synthetic
cgaacuggagcugcugauggag

SEQ ID NO: 1764 - RNA, 22 nt, Artificial Sequence
  Synthetic
cuugcuuaggacugggaauaca

SEQ ID NO: 1765 - RNA, 22 nt, Artificial Sequence
  Synthetic
cuuugcucccuugcuuaggacu

SEQ ID NO: 1766 - RNA, 22 nt, Artificial Sequence
  Synthetic
uacaguuugcgauccccgcguc

SEQ ID NO: 1767 - RNA, 22 nt, Artificial Sequence
  Synthetic
ucagcugcuccauccuggacgc

SEQ ID NO: 1768 - RNA, 22 nt, Artificial Sequence
  Synthetic
uccaacccguguccgaaaccuc

SEQ ID NO: 1769 - RNA, 20 nt, Artificial Sequence
  Synthetic
gaacccggaagugagaugca

SEQ ID NO: 1770 - RNA, 20 nt, Artificial Sequence
  Synthetic
gagccaauccugagcaggcu

SEQ ID NO: 1771 - RNA, 20 nt, Artificial Sequence
  Synthetic
gauuggcuccugcgugaggg

SEQ ID NO: 1772 - RNA, 20 nt, Artificial Sequence
  Synthetic
gccgccuugcaucucacuuc

SEQ ID NO: 1773 - RNA, 20 nt, Artificial Sequence
  Synthetic
gccguaaaccugaauuccgc

SEQ ID NO: 1774 - RNA, 20 nt, Artificial Sequence
  Synthetic
gcgaggccccgcccucacgc

SEQ ID NO: 1775 - RNA, 20 nt, Artificial Sequence
  Synthetic
ggccguaaaccugaauuccg

SEQ ID NO: 1776 - RNA, 20 nt, Artificial Sequence
  Synthetic
ggcuaccgcacgcagugagg

SEQ ID NO: 1777 - RNA, 20 nt, Artificial Sequence
  Synthetic
gggcggggaaaguagcggcg

SEQ ID NO: 1778 - RNA, 20 nt, Artificial Sequence
  Synthetic
guagccaaugagagccgaac

SEQ ID NO: 1779 - RNA, 20 nt, Artificial Sequence
  Synthetic
guucgucuccuagccugcuc

SEQ ID NO: 1780 - RNA, 20 nt, Artificial Sequence
  Synthetic
guuucucucgcgacacuuca

SEQ ID NO: 1781 - RNA, 20 nt, Artificial Sequence
  Synthetic
aaguccaguucggcucucau

SEQ ID NO: 1782 - RNA, 20 nt, Artificial Sequence
  Synthetic
accgcacgcagugagggggc

SEQ ID NO: 1783 - RNA, 20 nt, Artificial Sequence
  Synthetic
acggacgccguucucucccg

SEQ ID NO: 1784 - RNA, 20 nt, Artificial Sequence
  Synthetic
auuggcuaccgcacgcagug

SEQ ID NO: 1785 - RNA, 20 nt, Artificial Sequence
  Synthetic
auuggcuccugcgugagggc

SEQ ID NO: 1786 - RNA, 20 nt, Artificial Sequence
  Synthetic
caggauuggcuccugcguga

SEQ ID NO: 1787 - RNA, 20 nt, Artificial Sequence
  Synthetic
ccccgcccccucacugcgug

SEQ ID NO: 1788 - RNA, 20 nt, Artificial Sequence
  Synthetic
ccgcacgcagugagggggcg

SEQ ID NO: 1789 - RNA, 20 nt, Artificial Sequence
  Synthetic
ccgccuugcaucucacuucc

SEQ ID NO: 1790 - RNA, 20 nt, Artificial Sequence
  Synthetic
cgcaggagccaauccugagc

SEQ ID NO: 1791 - RNA, 20 nt, Artificial Sequence
  Synthetic
cguucucucccgcggaauuc

SEQ ID NO: 1792 - RNA, 20 nt, Artificial Sequence
  Synthetic
cugaauuccgcgggagagaa

SEQ ID NO: 1793 - RNA, 20 nt, Artificial Sequence
  Synthetic
uaccgcacgcagugaggggg

SEQ ID NO: 1794 - RNA, 20 nt, Artificial Sequence
  Synthetic
uagaugcuucaaguccaguu

SEQ ID NO: 1795 - RNA, 20 nt, Artificial Sequence
  Synthetic
ucaggauuggcuccugcgug

SEQ ID NO: 1796 - RNA, 20 nt, Artificial Sequence
  Synthetic
ucccgcggaauucagguuua

SEQ ID NO: 1797 - RNA, 20 nt, Artificial Sequence
  Synthetic
ucuccuagccugcucaggau

SEQ ID NO: 1798 - RNA, 20 nt, Artificial Sequence
  Synthetic
uggcuaccgcacgcagugag

SEQ ID NO: 1799 - RNA, 20 nt, Artificial Sequence
  Synthetic
uuggcuaccgcacgcaguga

SEQ ID NO: 1800 - RNA, 20 nt, Artificial Sequence
  Synthetic
uuggcuccugcgugagggcg

SEQ ID NO: 1801 - RNA, 22 nt, Artificial Sequence
  Synthetic
gagaacccgcagggccguaaac

SEQ ID NO: 1802 - RNA, 22 nt, Artificial Sequence
  Synthetic
aaacggacgccguucucucccg

SEQ ID NO: 1803 - RNA, 22 nt, Artificial Sequence
  Synthetic
aucgccgccuugcaucucacuu

SEQ ID NO: 1804 - RNA, 22 nt, Artificial Sequence
  Synthetic
cagaccguguuguuuucuuuuc

SEQ ID NO: 1805 - RNA, 22 nt, Artificial Sequence
  Synthetic
cggaauucagguuuacggcccu

SEQ ID NO: 1806 - RNA, 22 nt, Artificial Sequence
  Synthetic
cggguucgucuccuagccugcu

SEQ ID NO: 1807 - RNA, 22 nt, Artificial Sequence
  Synthetic
uccguuucucucgcgacacuuc

SEQ ID NO: 1808 - RNA, 20 nt, Artificial Sequence
  Synthetic
gaagcagagggcuaggugcu

SEQ ID NO: 1809 - RNA, 20 nt, Artificial Sequence
  Synthetic
gagagcggcguggacgcgug

SEQ ID NO: 1810 - RNA, 20 nt, Artificial Sequence
  Synthetic
gcagcuccgacuuccgggug

SEQ ID NO: 1811 - RNA, 20 nt, Artificial Sequence
  Synthetic
gccgcucuccuggggcacgc

SEQ ID NO: 1812 - RNA, 20 nt, Artificial Sequence
  Synthetic
gccgggaaaucagagucccg

SEQ ID NO: 1813 - RNA, 20 nt, Artificial Sequence
  Synthetic
gccguaccgcacccggaagu

SEQ ID NO: 1814 - RNA, 20 nt, Artificial Sequence
  Synthetic
gcggggucgcauuguggcua

SEQ ID NO: 1815 - RNA, 20 nt, Artificial Sequence
  Synthetic
gcgguugcggggucgcauug

SEQ ID NO: 1816 - RNA, 20 nt, Artificial Sequence
  Synthetic
gcguccacgccgcucuccug

SEQ ID NO: 1817 - RNA, 20 nt, Artificial Sequence
  Synthetic
gcgugcgcagcuccgacuuc

SEQ ID NO: 1818 - RNA, 20 nt, Artificial Sequence
  Synthetic
gcugugagugcgcgguugcg

SEQ ID NO: 1819 - RNA, 20 nt, Artificial Sequence
  Synthetic
ggcaggaagcugugagugcg

SEQ ID NO: 1820 - RNA, 20 nt, Artificial Sequence
  Synthetic
ggcccacgugauccgcaggg

SEQ ID NO: 1821 - RNA, 20 nt, Artificial Sequence
  Synthetic
ggccgcccugcggaucacgu

SEQ ID NO: 1822 - RNA, 20 nt, Artificial Sequence
  Synthetic
ggugcgguacggcgaagcag

SEQ ID NO: 1823 - RNA, 20 nt, Artificial Sequence
  Synthetic
ggugcugggugcuguugcca

SEQ ID NO: 1824 - RNA, 20 nt, Artificial Sequence
  Synthetic
ggugcuguugccaggggcag

SEQ ID NO: 1825 - RNA, 20 nt, Artificial Sequence
  Synthetic
guacggcgaagcagagggcu

SEQ ID NO: 1826 - RNA, 20 nt, Artificial Sequence
  Synthetic
gugcgguacggcgaagcaga

SEQ ID NO: 1827 - RNA, 20 nt, Artificial Sequence
  Synthetic
guggacgcgugcgggccuag

SEQ ID NO: 1828 - RNA, 20 nt, Artificial Sequence
  Synthetic
aagcugugagugcgcgguug

SEQ ID NO: 1829 - RNA, 20 nt, Artificial Sequence
  Synthetic
accgcgggacucugauuucc

SEQ ID NO: 1830 - RNA, 20 nt, Artificial Sequence
  Synthetic
acgcguccacgccgcucucc

SEQ ID NO: 1831 - RNA, 20 nt, Artificial Sequence
  Synthetic
agagcggcguggacgcgugc

SEQ ID NO: 1832 - RNA, 20 nt, Artificial Sequence
  Synthetic
agaggcccacgugauccgca

SEQ ID NO: 1833 - RNA, 20 nt, Artificial Sequence
  Synthetic
agcugugagugcgcgguugc

SEQ ID NO: 1834 - RNA, 20 nt, Artificial Sequence
  Synthetic
auccgcagggcggccgaggc

SEQ ID NO: 1835 - RNA, 20 nt, Artificial Sequence
  Synthetic
cccggcgugccccaggagag

SEQ ID NO: 1836 - RNA, 20 nt, Artificial Sequence
  Synthetic
ccgcucuccuggggcacgcc

SEQ ID NO: 1837 - RNA, 20 nt, Artificial Sequence
  Synthetic
cgaagcagagggcuaggugc

SEQ ID NO: 1838 - RNA, 20 nt, Artificial Sequence
  Synthetic
cggagcugcgcacgcaccgc

SEQ ID NO: 1839 - RNA, 20 nt, Artificial Sequence
  Synthetic
cggccgcccugcggaucacg

SEQ ID NO: 1840 - RNA, 20 nt, Artificial Sequence
  Synthetic
cgugauccgcagggcggccg

SEQ ID NO: 1841 - RNA, 20 nt, Artificial Sequence
  Synthetic
cgugcgcagcuccgacuucc

SEQ ID NO: 1842 - RNA, 20 nt, Artificial Sequence
  Synthetic
cugauuucccggcgugcccc

SEQ ID NO: 1843 - RNA, 20 nt, Artificial Sequence
  Synthetic
cugcuucgccguaccgcacc

SEQ ID NO: 1844 - RNA, 20 nt, Artificial Sequence
  Synthetic
uagaggcccacgugauccgc

SEQ ID NO: 1845 - RNA, 20 nt, Artificial Sequence
  Synthetic
uccgacuuccgggugcggua

SEQ ID NO: 1846 - RNA, 20 nt, Artificial Sequence
  Synthetic
ucggagcugcgcacgcaccg

SEQ ID NO: 1847 - RNA, 20 nt, Artificial Sequence
  Synthetic
ugcggaucacgugggccucu

SEQ ID NO: 1848 - RNA, 22 nt, Artificial Sequence
  Synthetic
ggaagcugugagugcgcgguug

SEQ ID NO: 1849 - RNA, 22 nt, Artificial Sequence
  Synthetic
ggugcgugcgcagcuccgacuu

SEQ ID NO: 1850 - RNA, 22 nt, Artificial Sequence
  Synthetic
agcuuccugccucggccgcccu

SEQ ID NO: 1851 - RNA, 22 nt, Artificial Sequence
  Synthetic
agggcggccgaggcaggaagcu

SEQ ID NO: 1852 - RNA, 22 nt, Artificial Sequence
  Synthetic
cggcgaagcagagggcuaggug

SEQ ID NO: 1853 - RNA, 22 nt, Artificial Sequence
  Synthetic
cuccuggggcacgccgggaaau

SEQ ID NO: 1854 - RNA, 20 nt, Artificial Sequence
  Synthetic
gagcgcggauacggcgccug

SEQ ID NO: 1855 - RNA, 20 nt, Artificial Sequence
  Synthetic
gaugaggcgggagugcgacu

SEQ ID NO: 1856 - RNA, 20 nt, Artificial Sequence
  Synthetic
gcaggcugccuuggaugagg

SEQ ID NO: 1857 - RNA, 20 nt, Artificial Sequence
  Synthetic
gcggauacggcgccugcggu

SEQ ID NO: 1858 - RNA, 20 nt, Artificial Sequence
  Synthetic
ggcgcuugcccgccaccugg

SEQ ID NO: 1859 - RNA, 20 nt, Artificial Sequence
  Synthetic
gggagccacgcaggcugccu

SEQ ID NO: 1860 - RNA, 20 nt, Artificial Sequence
  Synthetic
guuaaaaggguauguuucua

SEQ ID NO: 1861 - RNA, 20 nt, Artificial Sequence
  Synthetic
acggcgccugcggucggcau

SEQ ID NO: 1862 - RNA, 20 nt, Artificial Sequence
  Synthetic
augaggcgggagugcgacuu

SEQ ID NO: 1863 - RNA, 20 nt, Artificial Sequence
  Synthetic
cacgcaggcugccuuggaug

SEQ ID NO: 1864 - RNA, 20 nt, Artificial Sequence
  Synthetic
caggcugccuuggaugaggc

SEQ ID NO: 1865 - RNA, 20 nt, Artificial Sequence
  Synthetic
ccggagcccaugccgaccgc

SEQ ID NO: 1866 - RNA, 20 nt, Artificial Sequence
  Synthetic
ccugcggucggcaugggcuc

SEQ ID NO: 1867 - RNA, 20 nt, Artificial Sequence
  Synthetic
cuaaggugucgcugaaugua

SEQ ID NO: 1868 - RNA, 20 nt, Artificial Sequence
  Synthetic
cucauccaaggcagccugcg

SEQ ID NO: 1869 - RNA, 20 nt, Artificial Sequence
  Synthetic
cugcggucggcaugggcucc

SEQ ID NO: 1870 - RNA, 20 nt, Artificial Sequence
  Synthetic
cugcuagacgagcgcggaua

SEQ ID NO: 1871 - RNA, 20 nt, Artificial Sequence
  Synthetic
cuguuccuuuuccaaccacc

SEQ ID NO: 1872 - RNA, 20 nt, Artificial Sequence
  Synthetic
cuugcccgccaccugguggu

SEQ ID NO: 1873 - RNA, 20 nt, Artificial Sequence
  Synthetic
cuuuuccaaccaccaggugg

SEQ ID NO: 1874 - RNA, 20 nt, Artificial Sequence
  Synthetic
uacggcgccugcggucggca

SEQ ID NO: 1875 - RNA, 20 nt, Artificial Sequence
  Synthetic
ucccgggagcgcgcacgucc

SEQ ID NO: 1876 - RNA, 20 nt, Artificial Sequence
  Synthetic
uccgggacgugcgcgcuccc

SEQ ID NO: 1877 - RNA, 20 nt, Artificial Sequence
  Synthetic
ucgcacucccgccucaucca

SEQ ID NO: 1878 - RNA, 20 nt, Artificial Sequence
  Synthetic
ugaaaugugcugcguuaaaa

SEQ ID NO: 1879 - RNA, 20 nt, Artificial Sequence
  Synthetic
uugaaaugugcugcguuaaa

SEQ ID NO: 1880 - RNA, 20 nt, Artificial Sequence
  Synthetic
uugggcgcuugcccgccacc

SEQ ID NO: 1881 - RNA, 22 nt, Artificial Sequence
  Synthetic
guauugaaaugugcugcguuaa

SEQ ID NO: 1882 - RNA, 22 nt, Artificial Sequence
  Synthetic
aggguauguuucuaaggugucg

SEQ ID NO: 1883 - RNA, 22 nt, Artificial Sequence
  Synthetic
cccgggagccacgcaggcugcc

SEQ ID NO: 1884 - RNA, 22 nt, Artificial Sequence
  Synthetic
cgcaggcugccuuggaugaggc

SEQ ID NO: 1885 - RNA, 20 nt, Artificial Sequence
  Synthetic
gaaacagcuuagugggugug

SEQ ID NO: 1886 - RNA, 20 nt, Artificial Sequence
  Synthetic
gaggcgggaaacagcuuagu

SEQ ID NO: 1887 - RNA, 20 nt, Artificial Sequence
  Synthetic
gcagcugaguaaacacagaa

SEQ ID NO: 1888 - RNA, 20 nt, Artificial Sequence
  Synthetic
gcccagcuucccgcgcacgc

SEQ ID NO: 1889 - RNA, 20 nt, Artificial Sequence
  Synthetic
gccgcucgggggacguggga

SEQ ID NO: 1890 - RNA, 20 nt, Artificial Sequence
  Synthetic
gccguggccggacgccgcuc

SEQ ID NO: 1891 - RNA, 20 nt, Artificial Sequence
  Synthetic
gcuaaagucaccagcgugcg

SEQ ID NO: 1892 - RNA, 20 nt, Artificial Sequence
  Synthetic
gcugcaaggcuugaagcccc

SEQ ID NO: 1893 - RNA, 20 nt, Artificial Sequence
  Synthetic
ggaaacagcuuagugggugu

SEQ ID NO: 1894 - RNA, 20 nt, Artificial Sequence
  Synthetic
ggacgccgcucgggggacgu

SEQ ID NO: 1895 - RNA, 20 nt, Artificial Sequence
  Synthetic
ggaggcgggaaacagcuuag

SEQ ID NO: 1896 - RNA, 20 nt, Artificial Sequence
  Synthetic
gggaaacagcuuagugggug

SEQ ID NO: 1897 - RNA, 20 nt, Artificial Sequence
  Synthetic
gggccgcgucugcuuaugau

SEQ ID NO: 1898 - RNA, 20 nt, Artificial Sequence
  Synthetic
ggggacgugggaggggaggc

SEQ ID NO: 1899 - RNA, 20 nt, Artificial Sequence
  Synthetic
gggggacgugggaggggagg

SEQ ID NO: 1900 - RNA, 20 nt, Artificial Sequence
  Synthetic
ggugggguguaugcaagggu

SEQ ID NO: 1901 - RNA, 20 nt, Artificial Sequence
  Synthetic
accagcgugcgcgggaagcu

SEQ ID NO: 1902 - RNA, 20 nt, Artificial Sequence
  Synthetic
agggcugcguuucggugggu

SEQ ID NO: 1903 - RNA, 20 nt, Artificial Sequence
  Synthetic
augccugcgccuaggucgcg

SEQ ID NO: 1904 - RNA, 20 nt, Artificial Sequence
  Synthetic
caaccaaucauaagcagacg

SEQ ID NO: 1905 - RNA, 20 nt, Artificial Sequence
  Synthetic
cacgucccccgagcggcguc

SEQ ID NO: 1906 - RNA, 20 nt, Artificial Sequence
  Synthetic
cagggcugcguuucgguggg

SEQ ID NO: 1907 - RNA, 20 nt, Artificial Sequence
  Synthetic
ccccgagcggcguccggcca

SEQ ID NO: 1908 - RNA, 20 nt, Artificial Sequence
  Synthetic
ccgcucgggggacgugggag

SEQ ID NO: 1909 - RNA, 20 nt, Artificial Sequence
  Synthetic
ccguggccggacgccgcucg

SEQ ID NO: 1910 - RNA, 20 nt, Artificial Sequence
  Synthetic
cgccguggccggacgccgcu

SEQ ID NO: 1911 - RNA, 20 nt, Artificial Sequence
  Synthetic
cguggccggacgccgcucgg

SEQ ID NO: 1912 - RNA, 20 nt, Artificial Sequence
  Synthetic
cuaaagucaccagcgugcgc

SEQ ID NO: 1913 - RNA, 20 nt, Artificial Sequence
  Synthetic
cuacuaaggaugcgcgucug

SEQ ID NO: 1914 - RNA, 20 nt, Artificial Sequence
  Synthetic
cugauuggguguggucgccg

SEQ ID NO: 1915 - RNA, 20 nt, Artificial Sequence
  Synthetic
cugcuuaugauugguugccg

SEQ ID NO: 1916 - RNA, 20 nt, Artificial Sequence
  Synthetic
uacuaaggaugcgcgucugc

SEQ ID NO: 1917 - RNA, 20 nt, Artificial Sequence
  Synthetic
uacugcgcaugccugcgccu

SEQ ID NO: 1918 - RNA, 20 nt, Artificial Sequence
  Synthetic
ugcggguuuccgcgcgaccu

SEQ ID NO: 1919 - RNA, 20 nt, Artificial Sequence
  Synthetic
uuggguguggucgccguggc

SEQ ID NO: 1920 - RNA, 20 nt, Artificial Sequence
  Synthetic
uuuccgcgcgaccuaggcgc

SEQ ID NO: 1921 - RNA, 22 nt, Artificial Sequence
  Synthetic
gaaacgcagcccuggaagcuga

SEQ ID NO: 1922 - RNA, 22 nt, Artificial Sequence
  Synthetic
gcgggaaacagcuuagugggug

SEQ ID NO: 1923 - RNA, 22 nt, Artificial Sequence
  Synthetic
gcucuacuaaggaugcgcgucu

SEQ ID NO: 1924 - RNA, 22 nt, Artificial Sequence
  Synthetic
aaacacagaaaggagcucuacu

SEQ ID NO: 1925 - RNA, 22 nt, Artificial Sequence
  Synthetic
agccccugggugggguguaugc

SEQ ID NO: 1926 - RNA, 22 nt, Artificial Sequence
  Synthetic
aggggaggcgggaaacagcuua

SEQ ID NO: 1927 - RNA, 22 nt, Artificial Sequence
  Synthetic
cagcuuccagggcugcguuucg

SEQ ID NO: 1928 - RNA, 22 nt, Artificial Sequence
  Synthetic
ccagggcugcguuucggugggu

SEQ ID NO: 1929 - RNA, 22 nt, Artificial Sequence
  Synthetic
ccaggggcuucaagccuugcag

SEQ ID NO: 1930 - RNA, 22 nt, Artificial Sequence
  Synthetic
ucagcugcaaggcuugaagccc

SEQ ID NO: 1931 - RNA, 22 nt, Artificial Sequence
  Synthetic
ugcaaggcuugaagccccuggg

SEQ ID NO: 1932 - RNA, 20 nt, Artificial Sequence
  Synthetic
gacccugcgugcgccggggc

SEQ ID NO: 1933 - RNA, 20 nt, Artificial Sequence
  Synthetic
gagacauggcagggcaagga

SEQ ID NO: 1934 - RNA, 20 nt, Artificial Sequence
  Synthetic
gaggccccgcccccccgccc

SEQ ID NO: 1935 - RNA, 20 nt, Artificial Sequence
  Synthetic
gcagggcaaggauggcagcc

SEQ ID NO: 1936 - RNA, 20 nt, Artificial Sequence
  Synthetic
gccgcgacccugcgugcgcc

SEQ ID NO: 1937 - RNA, 20 nt, Artificial Sequence
  Synthetic
gccugcacaaauggggacga

SEQ ID NO: 1938 - RNA, 20 nt, Artificial Sequence
  Synthetic
gcgggcucgcgcuccucgcc

SEQ ID NO: 1939 - RNA, 20 nt, Artificial Sequence
  Synthetic
gcucgcgcccgcagacgccu

SEQ ID NO: 1940 - RNA, 20 nt, Artificial Sequence
  Synthetic
gcuuccggcgagacauggca

SEQ ID NO: 1941 - RNA, 20 nt, Artificial Sequence
  Synthetic
ggcagcccggcggcagggcc

SEQ ID NO: 1942 - RNA, 20 nt, Artificial Sequence
  Synthetic
ggcuuccggcgagacauggc

SEQ ID NO: 1943 - RNA, 20 nt, Artificial Sequence
  Synthetic
gggcaaggauggcagcccgg

SEQ ID NO: 1944 - RNA, 20 nt, Artificial Sequence
  Synthetic
gggccucgccugcacaaaug

SEQ ID NO: 1945 - RNA, 20 nt, Artificial Sequence
  Synthetic
ggggccucgccugcacaaau

SEQ ID NO: 1946 - RNA, 20 nt, Artificial Sequence
  Synthetic
gucucgccggaagccugcgu

SEQ ID NO: 1947 - RNA, 20 nt, Artificial Sequence
  Synthetic
gugcgccggggcgggggggc

SEQ ID NO: 1948 - RNA, 20 nt, Artificial Sequence
  Synthetic
aaggauggcagcccggcggc

SEQ ID NO: 1949 - RNA, 20 nt, Artificial Sequence
  Synthetic
acgccugggaacugcggccg

SEQ ID NO: 1950 - RNA, 20 nt, Artificial Sequence
  Synthetic
aggauggcagcccggcggca

SEQ ID NO: 1951 - RNA, 20 nt, Artificial Sequence
  Synthetic
caaauggggacgaggggggc

SEQ ID NO: 1952 - RNA, 20 nt, Artificial Sequence
  Synthetic
ccccggcgcacgcagggucg

SEQ ID NO: 1953 - RNA, 20 nt, Artificial Sequence
  Synthetic
ccgcagacgccugggaacug

SEQ ID NO: 1954 - RNA, 20 nt, Artificial Sequence
  Synthetic
ccgcaguucccaggcgucug

SEQ ID NO: 1955 - RNA, 20 nt, Artificial Sequence
  Synthetic
ccgcgacccugcgugcgccg

SEQ ID NO: 1956 - RNA, 20 nt, Artificial Sequence
  Synthetic
ccugcacaaauggggacgag

SEQ ID NO: 1957 - RNA, 20 nt, Artificial Sequence
  Synthetic
cgacccugcgugcgccgggg

SEQ ID NO: 1958 - RNA, 20 nt, Artificial Sequence
  Synthetic
cgcaggcuuccggcgagaca

SEQ ID NO: 1959 - RNA, 20 nt, Artificial Sequence
  Synthetic
cgcaguucccaggcgucugc

SEQ ID NO: 1960 - RNA, 20 nt, Artificial Sequence
  Synthetic
cgccgcgacccugcgugcgc

SEQ ID NO: 1961 - RNA, 20 nt, Artificial Sequence
  Synthetic
cgccugcacaaauggggacg

SEQ ID NO: 1962 - RNA, 20 nt, Artificial Sequence
  Synthetic
cgccugggaacugcggccgc

SEQ ID NO: 1963 - RNA, 20 nt, Artificial Sequence
  Synthetic
cguccccauuugugcaggcg

SEQ ID NO: 1964 - RNA, 20 nt, Artificial Sequence
  Synthetic
cuugcccugccaugucucgc

SEQ ID NO: 1965 - RNA, 20 nt, Artificial Sequence
  Synthetic
ucaaguuuggcgcgaaauug

SEQ ID NO: 1966 - RNA, 20 nt, Artificial Sequence
  Synthetic
ucucgccggaagccugcguc

SEQ ID NO: 1967 - RNA, 20 nt, Artificial Sequence
  Synthetic
uggcgaggagcgcgagcccg

SEQ ID NO: 1968 - RNA, 22 nt, Artificial Sequence
  Synthetic
cgcccccccgccccggcgcacg

SEQ ID NO: 1969 - RNA, 22 nt, Artificial Sequence
  Synthetic
uuccggcgagacauggcagggc

SEQ ID NO: 1970 - RNA, 20 nt, Artificial Sequence
  Synthetic
gacguggggaagggcggggc

SEQ ID NO: 1971 - RNA, 20 nt, Artificial Sequence
  Synthetic
gcgccuguugauuggccacu

SEQ ID NO: 1972 - RNA, 20 nt, Artificial Sequence
  Synthetic
gcgcgcggcgacguggggaa

SEQ ID NO: 1973 - RNA, 20 nt, Artificial Sequence
  Synthetic
gcgcuccgccggaggaaccc

SEQ ID NO: 1974 - RNA, 20 nt, Artificial Sequence
  Synthetic
gcggcgacguggggaagggc

SEQ ID NO: 1975 - RNA, 20 nt, Artificial Sequence
  Synthetic
gcuccugcuggcgggaaauc

SEQ ID NO: 1976 - RNA, 20 nt, Artificial Sequence
  Synthetic
gcuggcacacugguggguag

SEQ ID NO: 1977 - RNA, 20 nt, Artificial Sequence
  Synthetic
ggcacacugguggguagggg

SEQ ID NO: 1978 - RNA, 20 nt, Artificial Sequence
  Synthetic
ggccccaguggccaaucaac

SEQ ID NO: 1979 - RNA, 20 nt, Artificial Sequence
  Synthetic
ggcgccucgccgugcgcggg

SEQ ID NO: 1980 - RNA, 20 nt, Artificial Sequence
  Synthetic
ggcgccuguugauuggccac

SEQ ID NO: 1981 - RNA, 20 nt, Artificial Sequence
  Synthetic
ggcggggcuggcacacuggu

SEQ ID NO: 1982 - RNA, 20 nt, Artificial Sequence
  Synthetic
ggcuggcacacuggugggua

SEQ ID NO: 1983 - RNA, 20 nt, Artificial Sequence
  Synthetic
ggcuggcacgcuggcgguga

SEQ ID NO: 1984 - RNA, 20 nt, Artificial Sequence
  Synthetic
gggcuggcacacuggugggu

SEQ ID NO: 1985 - RNA, 20 nt, Artificial Sequence
  Synthetic
gggcuggcacgcuggcggug

SEQ ID NO: 1986 - RNA, 20 nt, Artificial Sequence
  Synthetic
ggggaggcgcgcuccgccgg

SEQ ID NO: 1987 - RNA, 20 nt, Artificial Sequence
  Synthetic
gucgccgcgcgcccgggggc

SEQ ID NO: 1988 - RNA, 20 nt, Artificial Sequence
  Synthetic
gugcgcgggcggugcgcgcc

SEQ ID NO: 1989 - RNA, 20 nt, Artificial Sequence
  Synthetic
guugauuggccacuggggcc

SEQ ID NO: 1990 - RNA, 20 nt, Artificial Sequence
  Synthetic
aaagcaccgcaucuaccgcg

SEQ ID NO: 1991 - RNA, 20 nt, Artificial Sequence
  Synthetic
aacaggcgccucgccgugcg

SEQ ID NO: 1992 - RNA, 20 nt, Artificial Sequence
  Synthetic
acaggcgccucgccgugcgc

SEQ ID NO: 1993 - RNA, 20 nt, Artificial Sequence
  Synthetic
accgcgcggcuccugcuggc

SEQ ID NO: 1994 - RNA, 20 nt, Artificial Sequence
  Synthetic
acggcgaggcgccuguugau

SEQ ID NO: 1995 - RNA, 20 nt, Artificial Sequence
  Synthetic
aucuaccgcgcggcuccugc

SEQ ID NO: 1996 - RNA, 20 nt, Artificial Sequence
  Synthetic
caggagccgcgcgguagaug

SEQ ID NO: 1997 - RNA, 20 nt, Artificial Sequence
  Synthetic
cccccagauuucccgccagc

SEQ ID NO: 1998 - RNA, 20 nt, Artificial Sequence
  Synthetic
cccccgggcgcgcggcgacg

SEQ ID NO: 1999 - RNA, 20 nt, Artificial Sequence
  Synthetic
ccccgggcgcgcggcgacgu

SEQ ID NO: 2000 - RNA, 20 nt, Artificial Sequence
  Synthetic
cgcaccgcccgcgcacggcg

SEQ ID NO: 2001 - RNA, 20 nt, Artificial Sequence
  Synthetic
cgccuguugauuggccacug

SEQ ID NO: 2002 - RNA, 20 nt, Artificial Sequence
  Synthetic
cgcgcuccgccggaggaacc

SEQ ID NO: 2003 - RNA, 20 nt, Artificial Sequence
  Synthetic
cgcggcgacguggggaaggg

SEQ ID NO: 2004 - RNA, 20 nt, Artificial Sequence
  Synthetic
cggaggaacccgggccccag

SEQ ID NO: 2005 - RNA, 20 nt, Artificial Sequence
  Synthetic
cgucgccgcgcgcccggggg

SEQ ID NO: 2006 - RNA, 20 nt, Artificial Sequence
  Synthetic
cuggcgggaaaucugggggg

SEQ ID NO: 2007 - RNA, 20 nt, Artificial Sequence
  Synthetic
uaccgcgcggcuccugcugg

SEQ ID NO: 2008 - RNA, 20 nt, Artificial Sequence
  Synthetic
uggcgcgcaccgcccgcgca

SEQ ID NO: 2009 - RNA, 20 nt, Artificial Sequence
  Synthetic
uggggcccggguuccuccgg

SEQ ID NO: 2010 - RNA, 22 nt, Artificial Sequence
  Synthetic
gaagggcggggcuggcacacug

SEQ ID NO: 2011 - RNA, 22 nt, Artificial Sequence
  Synthetic
ccuguugauuggccacuggggc

SEQ ID NO: 2012 - RNA, 20 nt, Artificial Sequence
  Synthetic
gacaguggugaaccgcaucg

SEQ ID NO: 2013 - RNA, 20 nt, Artificial Sequence
  Synthetic
gacuggcacgucagggaacc

SEQ ID NO: 2014 - RNA, 20 nt, Artificial Sequence
  Synthetic
gcacgaggcacugaggugau

SEQ ID NO: 2015 - RNA, 20 nt, Artificial Sequence
  Synthetic
gccaaaaugucguucguggc

SEQ ID NO: 2016 - RNA, 20 nt, Artificial Sequence
  Synthetic
gcgcaagcgcauauccuucu

SEQ ID NO: 2017 - RNA, 20 nt, Artificial Sequence
  Synthetic
gcgcaugcccacaacggcgg

SEQ ID NO: 2018 - RNA, 20 nt, Artificial Sequence
  Synthetic
gcgcuguacaugccucugcc

SEQ ID NO: 2019 - RNA, 20 nt, Artificial Sequence
  Synthetic
gcggacacgccucuuugccc

SEQ ID NO: 2020 - RNA, 20 nt, Artificial Sequence
  Synthetic
gcuacugcccgcuaccuaga

SEQ ID NO: 2021 - RNA, 20 nt, Artificial Sequence
  Synthetic
gcuccuaaaaacgaaccaau

SEQ ID NO: 2022 - RNA, 20 nt, Artificial Sequence
  Synthetic
ggaaacgucuagaugcucaa

SEQ ID NO: 2023 - RNA, 20 nt, Artificial Sequence
  Synthetic
ggcagggguuauucggcggc

SEQ ID NO: 2024 - RNA, 20 nt, Artificial Sequence
  Synthetic
ggccgcgucacucaauggcg

SEQ ID NO: 2025 - RNA, 20 nt, Artificial Sequence
  Synthetic
gguacggagggagucgagcc

SEQ ID NO: 2026 - RNA, 20 nt, Artificial Sequence
  Synthetic
ggugaaccgcaucgcggcgg

SEQ ID NO: 2027 - RNA, 20 nt, Artificial Sequence
  Synthetic
gguucccugacgugccaguc

SEQ ID NO: 2028 - RNA, 20 nt, Artificial Sequence
  Synthetic
gguucguuuuuaggagcucg

SEQ ID NO: 2029 - RNA, 20 nt, Artificial Sequence
  Synthetic
guccgcgccauugagugacg

SEQ ID NO: 2030 - RNA, 20 nt, Artificial Sequence
  Synthetic
gucgagccgggcucacuuaa

SEQ ID NO: 2031 - RNA, 20 nt, Artificial Sequence
  Synthetic
guggugaaccgcaucgcggc

SEQ ID NO: 2032 - RNA, 20 nt, Artificial Sequence
  Synthetic
acagcgcaugcccacaacgg

SEQ ID NO: 2033 - RNA, 20 nt, Artificial Sequence
  Synthetic
acuuaagggcuacgacuuaa

SEQ ID NO: 2034 - RNA, 20 nt, Artificial Sequence
  Synthetic
agucgagccgggcucacuua

SEQ ID NO: 2035 - RNA, 20 nt, Artificial Sequence
  Synthetic
aguggugaaccgcaucgcgg

SEQ ID NO: 2036 - RNA, 20 nt, Artificial Sequence
  Synthetic
auggcguaagcuacagcuga

SEQ ID NO: 2037 - RNA, 20 nt, Artificial Sequence
  Synthetic
ccacaacggcggaggccgcc

SEQ ID NO: 2038 - RNA, 20 nt, Artificial Sequence
  Synthetic
cccacaacggcggaggccgc

SEQ ID NO: 2039 - RNA, 20 nt, Artificial Sequence
  Synthetic
ccggcggccuccgccguugu

SEQ ID NO: 2040 - RNA, 20 nt, Artificial Sequence
  Synthetic
cgcauauccuucuagguagc

SEQ ID NO: 2041 - RNA, 20 nt, Artificial Sequence
  Synthetic
cgcggacacgccucuuugcc

SEQ ID NO: 2042 - RNA, 20 nt, Artificial Sequence
  Synthetic
cggcgggggaaguuauccag

SEQ ID NO: 2043 - RNA, 20 nt, Artificial Sequence
  Synthetic
cguucguggcagggguuauu

SEQ ID NO: 2044 - RNA, 20 nt, Artificial Sequence
  Synthetic
cuuaagggcuacgacuuaac

SEQ ID NO: 2045 - RNA, 20 nt, Artificial Sequence
  Synthetic
uaacgggccgcgucacucaa

SEQ ID NO: 2046 - RNA, 20 nt, Artificial Sequence
  Synthetic
uaacuucccccgccgcgaug

SEQ ID NO: 2047 - RNA, 20 nt, Artificial Sequence
  Synthetic
uagcgggcaguagccgcuuc

SEQ ID NO: 2048 - RNA, 20 nt, Artificial Sequence
  Synthetic
ucguggcagggguuauucgg

SEQ ID NO: 2049 - RNA, 20 nt, Artificial Sequence
  Synthetic
ugauagcauuagcuggccgc

SEQ ID NO: 2050 - RNA, 20 nt, Artificial Sequence
  Synthetic
uggcgccaaaaugucguucg

SEQ ID NO: 2051 - RNA, 20 nt, Artificial Sequence
  Synthetic
uggugaaccgcaucgcggcg

SEQ ID NO: 2052 - RNA, 22 nt, Artificial Sequence
  Synthetic
gacgaagagacccagcaaccca

SEQ ID NO: 2053 - RNA, 22 nt, Artificial Sequence
  Synthetic
gaugauugagaacugguacgga

SEQ ID NO: 2054 - RNA, 22 nt, Artificial Sequence
  Synthetic
gcaaagaggcguguccgcgcca

SEQ ID NO: 2055 - RNA, 22 nt, Artificial Sequence
  Synthetic
gccagucaaauuucucaacucu

SEQ ID NO: 2056 - RNA, 22 nt, Artificial Sequence
  Synthetic
gcgccaaaaugucguucguggc

SEQ ID NO: 2057 - RNA, 22 nt, Artificial Sequence
  Synthetic
gcggcuacugcccgcuaccuag

SEQ ID NO: 2058 - RNA, 22 nt, Artificial Sequence
  Synthetic
ggguuguuuggaguguaagugg

SEQ ID NO: 2059 - RNA, 22 nt, Artificial Sequence
  Synthetic
guccaaucaauagcugccgcug

SEQ ID NO: 2060 - RNA, 22 nt, Artificial Sequence
  Synthetic
aauuucucaacucuguggguug

SEQ ID NO: 2061 - RNA, 22 nt, Artificial Sequence
  Synthetic
augcccacaacggcggaggccg

SEQ ID NO: 2062 - RNA, 22 nt, Artificial Sequence
  Synthetic
ccgagaccuuuuaaggguuguu

SEQ ID NO: 2063 - RNA, 22 nt, Artificial Sequence
  Synthetic
ccgcucucccccgagaccuuuu

SEQ ID NO: 2064 - RNA, 22 nt, Artificial Sequence
  Synthetic
cggcagcuauugauuggacagc

SEQ ID NO: 2065 - RNA, 22 nt, Artificial Sequence
  Synthetic
cuuugauagcauuagcuggccg

SEQ ID NO: 2066 - RNA, 22 nt, Artificial Sequence
  Synthetic
uagcugccgcugaagggugggg

SEQ ID NO: 2067 - RNA, 22 nt, Artificial Sequence
  Synthetic
ucaccacugucucguccagccg

SEQ ID NO: 2068 - RNA, 22 nt, Artificial Sequence
  Synthetic
uugguucguuuuuaggagcucg

SEQ ID NO: 2069 - RNA, 20 nt, Artificial Sequence
  Synthetic
gacagagccaauaggcgaaa

SEQ ID NO: 2070 - RNA, 20 nt, Artificial Sequence
  Synthetic
gacugggaaaguucccucca

SEQ ID NO: 2071 - RNA, 20 nt, Artificial Sequence
  Synthetic
gcaacacccgauccgccucg

SEQ ID NO: 2072 - RNA, 20 nt, Artificial Sequence
  Synthetic
gcagccaaugggaguucagg

SEQ ID NO: 2073 - RNA, 20 nt, Artificial Sequence
  Synthetic
gccaaugggaguucaggagg

SEQ ID NO: 2074 - RNA, 20 nt, Artificial Sequence
  Synthetic
gccgccccgcccggaaaggg

SEQ ID NO: 2075 - RNA, 20 nt, Artificial Sequence
  Synthetic
gcgccugugggagcccugga

SEQ ID NO: 2076 - RNA, 20 nt, Artificial Sequence
  Synthetic
ggacugggaaaguucccucc

SEQ ID NO: 2077 - RNA, 20 nt, Artificial Sequence
  Synthetic
gggaacuuucccaguccccg

SEQ ID NO: 2078 - RNA, 20 nt, Artificial Sequence
  Synthetic
gugcuccacccuuuccgggc

SEQ ID NO: 2079 - RNA, 20 nt, Artificial Sequence
  Synthetic
guucccuccagggcucccac

SEQ ID NO: 2080 - RNA, 20 nt, Artificial Sequence
  Synthetic
aaagcagccaaugggaguuc

SEQ ID NO: 2081 - RNA, 20 nt, Artificial Sequence
  Synthetic
acccgauccgccucggggac

SEQ ID NO: 2082 - RNA, 20 nt, Artificial Sequence
  Synthetic
agcgccugugggagcccugg

SEQ ID NO: 2083 - RNA, 20 nt, Artificial Sequence
  Synthetic
aguauuuuugccgccccgcc

SEQ ID NO: 2084 - RNA, 20 nt, Artificial Sequence
  Synthetic
augcaacacccgauccgccu

SEQ ID NO: 2085 - RNA, 20 nt, Artificial Sequence
  Synthetic
cccgauccgccucggggacu

SEQ ID NO: 2086 - RNA, 20 nt, Artificial Sequence
  Synthetic
cgaccuuugacagagccaau

SEQ ID NO: 2087 - RNA, 20 nt, Artificial Sequence
  Synthetic
cggagcgccugugggagccc

SEQ ID NO: 2088 - RNA, 20 nt, Artificial Sequence
  Synthetic
cggaucggguguugcaucca

SEQ ID NO: 2089 - RNA, 20 nt, Artificial Sequence
  Synthetic
cggugugcucugauuggccc

SEQ ID NO: 2090 - RNA, 20 nt, Artificial Sequence
  Synthetic
cuucgugacgucaaagagcc

SEQ ID NO: 2091 - RNA, 20 nt, Artificial Sequence
  Synthetic
ucaggaggcggagcgccugu

SEQ ID NO: 2092 - RNA, 20 nt, Artificial Sequence
  Synthetic
ucccaguccccgaggcggau

SEQ ID NO: 2093 - RNA, 20 nt, Artificial Sequence
  Synthetic
uccgccuccugaacucccau

SEQ ID NO: 2094 - RNA, 20 nt, Artificial Sequence
  Synthetic
ucgccuauuggcucugucaa

SEQ ID NO: 2095 - RNA, 20 nt, Artificial Sequence
  Synthetic
ugcaacacccgauccgccuc

SEQ ID NO: 2096 - RNA, 20 nt, Artificial Sequence
  Synthetic
uucaggaggcggagcgccug

SEQ ID NO: 2097 - RNA, 20 nt, Artificial Sequence
  Synthetic
uucgugacgucaaagagccu

SEQ ID NO: 2098 - RNA, 20 nt, Artificial Sequence
  Synthetic
uuugccgccccgcccggaaa

SEQ ID NO: 2099 - RNA, 20 nt, Artificial Sequence
  Synthetic
uuuugccgccccgcccggaa

SEQ ID NO: 2100 - RNA, 22 nt, Artificial Sequence
  Synthetic
gggaacuuucccaguccccgag

SEQ ID NO: 2101 - RNA, 22 nt, Artificial Sequence
  Synthetic
cacaacgucgaaagcagccaau

SEQ ID NO: 2102 - RNA, 22 nt, Artificial Sequence
  Synthetic
cuuucccaguccccgaggcgga

SEQ ID NO: 2103 - RNA, 22 nt, Artificial Sequence
  Synthetic
uauuuuugccgccccgcccgga

SEQ ID NO: 2104 - RNA, 20 nt, Artificial Sequence
  Synthetic
gaacaacgcgagucggcgcg

SEQ ID NO: 2105 - RNA, 20 nt, Artificial Sequence
  Synthetic
gacacccggugggacucaga

SEQ ID NO: 2106 - RNA, 20 nt, Artificial Sequence
  Synthetic
gagugcgaaccgggcggcgg

SEQ ID NO: 2107 - RNA, 20 nt, Artificial Sequence
  Synthetic
gccacugcugugccgguccc

SEQ ID NO: 2108 - RNA, 20 nt, Artificial Sequence
  Synthetic
gccccgauuggcgggacgcg

SEQ ID NO: 2109 - RNA, 20 nt, Artificial Sequence
  Synthetic
gccgcguuuggcgcucgguc

SEQ ID NO: 2110 - RNA, 20 nt, Artificial Sequence
  Synthetic
gccucgcgucccgccaaucg

SEQ ID NO: 2111 - RNA, 20 nt, Artificial Sequence
  Synthetic
gcggcgcuugauugggcugg

SEQ ID NO: 2112 - RNA, 20 nt, Artificial Sequence
  Synthetic
gcgggcgcccguccaaucac

SEQ ID NO: 2113 - RNA, 20 nt, Artificial Sequence
  Synthetic
ggaccggcacagcaguggcg

SEQ ID NO: 2114 - RNA, 20 nt, Artificial Sequence
  Synthetic
ggcgauugggcugccgcguu

SEQ ID NO: 2115 - RNA, 20 nt, Artificial Sequence
  Synthetic
ggcggcgcuugauugggcug

SEQ ID NO: 2116 - RNA, 20 nt, Artificial Sequence
  Synthetic
gggcggcgcuugauugggcu

SEQ ID NO: 2117 - RNA, 20 nt, Artificial Sequence
  Synthetic
gggcuccgggagugcgaacc

SEQ ID NO: 2118 - RNA, 20 nt, Artificial Sequence
  Synthetic
gggcugccgcguuuggcgcu

SEQ ID NO: 2119 - RNA, 20 nt, Artificial Sequence
  Synthetic
ggggcggcgcuugauugggc

SEQ ID NO: 2120 - RNA, 20 nt, Artificial Sequence
  Synthetic
ggggcuccgggagugcgaac

SEQ ID NO: 2121 - RNA, 20 nt, Artificial Sequence
  Synthetic
ggggggccaaauaaaagcga

SEQ ID NO: 2122 - RNA, 20 nt, Artificial Sequence
  Synthetic
ggucgcguccgacacccggu

SEQ ID NO: 2123 - RNA, 20 nt, Artificial Sequence
  Synthetic
guccggucgcguccgacacc

SEQ ID NO: 2124 - RNA, 20 nt, Artificial Sequence
  Synthetic
aacaacgcgagucggcgcgc

SEQ ID NO: 2125 - RNA, 20 nt, Artificial Sequence
  Synthetic
aaucggggcggcgcuugauu

SEQ ID NO: 2126 - RNA, 20 nt, Artificial Sequence
  Synthetic
accggaccgagcgccaaacg

SEQ ID NO: 2127 - RNA, 20 nt, Artificial Sequence
  Synthetic
acgaagguaacgcgccgcug

SEQ ID NO: 2128 - RNA, 20 nt, Artificial Sequence
  Synthetic
agguaacgcgccgcugcggg

SEQ ID NO: 2129 - RNA, 20 nt, Artificial Sequence
  Synthetic
caagcgccgccccgauuggc

SEQ ID NO: 2130 - RNA, 20 nt, Artificial Sequence
  Synthetic
caaucaagcgccgccccgau

SEQ ID NO: 2131 - RNA, 20 nt, Artificial Sequence
  Synthetic
caaucgccaucgcuuuuauu

SEQ ID NO: 2132 - RNA, 20 nt, Artificial Sequence
  Synthetic
caaucggggcggcgcuugau

SEQ ID NO: 2133 - RNA, 20 nt, Artificial Sequence
  Synthetic
caccgggugucggacgcgac

SEQ ID NO: 2134 - RNA, 20 nt, Artificial Sequence
  Synthetic
ccgauuggcgggacgcgagg

SEQ ID NO: 2135 - RNA, 20 nt, Artificial Sequence
  Synthetic
ccgccucgcgucccgccaau

SEQ ID NO: 2136 - RNA, 20 nt, Artificial Sequence
  Synthetic
cgagucggcgcgcgggacga

SEQ ID NO: 2137 - RNA, 20 nt, Artificial Sequence
  Synthetic
cgauuggcgggacgcgaggc

SEQ ID NO: 2138 - RNA, 20 nt, Artificial Sequence
  Synthetic
cgccgcccgguucgcacucc

SEQ ID NO: 2139 - RNA, 20 nt, Artificial Sequence
  Synthetic
cgccucgcgucccgccaauc

SEQ ID NO: 2140 - RNA, 20 nt, Artificial Sequence
  Synthetic
cgcgcgggaacaacgcgagu

SEQ ID NO: 2141 - RNA, 20 nt, Artificial Sequence
  Synthetic
cggucgcguccgacacccgg

SEQ ID NO: 2142 - RNA, 20 nt, Artificial Sequence
  Synthetic
ucaagcgccgccccgauugg

SEQ ID NO: 2143 - RNA, 20 nt, Artificial Sequence
  Synthetic
ucgcgucccgccaaucgggg

SEQ ID NO: 2144 - RNA, 22 nt, Artificial Sequence
  Synthetic
gccgccggggcuccacugccuu

SEQ ID NO: 2145 - RNA, 22 nt, Artificial Sequence
  Synthetic
gcggcccggccggcggggcucc

SEQ ID NO: 2146 - RNA, 22 nt, Artificial Sequence
  Synthetic
gggggcgacgcgcgggaacaac

SEQ ID NO: 2147 - RNA, 22 nt, Artificial Sequence
  Synthetic
ccccgccacugcugugccgguc

SEQ ID NO: 2148 - RNA, 22 nt, Artificial Sequence
  Synthetic
cuccacugccuucugaguccca

SEQ ID NO: 2149 - RNA, 20 nt, Artificial Sequence
  Synthetic
gagcugagccuaagcccugg

SEQ ID NO: 2150 - RNA, 20 nt, Artificial Sequence
  Synthetic
gaguuucggccuucgccugc

SEQ ID NO: 2151 - RNA, 20 nt, Artificial Sequence
  Synthetic
gauccuacugcuuuuccagc

SEQ ID NO: 2152 - RNA, 20 nt, Artificial Sequence
  Synthetic
gaucggccaguggcgacagc

SEQ ID NO: 2153 - RNA, 20 nt, Artificial Sequence
  Synthetic
gaugccgacuuuagaggagg

SEQ ID NO: 2154 - RNA, 20 nt, Artificial Sequence
  Synthetic
gcagaugccgacuuuagagg

SEQ ID NO: 2155 - RNA, 20 nt, Artificial Sequence
  Synthetic
gcugagccuaagcccuggcg

SEQ ID NO: 2156 - RNA, 20 nt, Artificial Sequence
  Synthetic
gcuugcagccacccuugaau

SEQ ID NO: 2157 - RNA, 20 nt, Artificial Sequence
  Synthetic
ggcuguaggugagaacuaua

SEQ ID NO: 2158 - RNA, 20 nt, Artificial Sequence
  Synthetic
gggcuguaggugagaacuau

SEQ ID NO: 2159 - RNA, 20 nt, Artificial Sequence
  Synthetic
guacagagucaaccaauuca

SEQ ID NO: 2160 - RNA, 20 nt, Artificial Sequence
  Synthetic
aaagcaguaggaucggccag

SEQ ID NO: 2161 - RNA, 20 nt, Artificial Sequence
  Synthetic
aacuccgccuccucuaaagu

SEQ ID NO: 2162 - RNA, 20 nt, Artificial Sequence
  Synthetic
acugcuuuuccagcaggcga

SEQ ID NO: 2163 - RNA, 20 nt, Artificial Sequence
  Synthetic
agagucaaccaauucaaggg

SEQ ID NO: 2164 - RNA, 20 nt, Artificial Sequence
  Synthetic
agcugagccuaagcccuggc

SEQ ID NO: 2165 - RNA, 20 nt, Artificial Sequence
  Synthetic
ccaaagccccgccagggcuu

SEQ ID NO: 2166 - RNA, 20 nt, Artificial Sequence
  Synthetic
ccuaagcccuggcggggcuu

SEQ ID NO: 2167 - RNA, 20 nt, Artificial Sequence
  Synthetic
cgugcucauuggcuggugua

SEQ ID NO: 2168 - RNA, 20 nt, Artificial Sequence
  Synthetic
cuaagcccuggcggggcuuu

SEQ ID NO: 2169 - RNA, 20 nt, Artificial Sequence
  Synthetic
cuacagcccaaagccccgcc

SEQ ID NO: 2170 - RNA, 20 nt, Artificial Sequence
  Synthetic
cuggcggggcuuugggcugu

SEQ ID NO: 2171 - RNA, 20 nt, Artificial Sequence
  Synthetic
cuuuagaggaggcggaguuu

SEQ ID NO: 2172 - RNA, 20 nt, Artificial Sequence
  Synthetic
uacagagucaaccaauucaa

SEQ ID NO: 2173 - RNA, 20 nt, Artificial Sequence
  Synthetic
uacagcccaaagccccgcca

SEQ ID NO: 2174 - RNA, 20 nt, Artificial Sequence
  Synthetic
ucagcuccugcugucgccac

SEQ ID NO: 2175 - RNA, 20 nt, Artificial Sequence
  Synthetic
ucgccugcuggaaaagcagu

SEQ ID NO: 2176 - RNA, 20 nt, Artificial Sequence
  Synthetic
ugcgcagaugccgacuuuag

SEQ ID NO: 2177 - RNA, 20 nt, Artificial Sequence
  Synthetic
ugcggcgcgugcucauuggc

SEQ ID NO: 2178 - RNA, 20 nt, Artificial Sequence
  Synthetic
ugcuggaaaagcaguaggau

SEQ ID NO: 2179 - RNA, 20 nt, Artificial Sequence
  Synthetic
uggcugcggcgcgugcucau

SEQ ID NO: 2180 - RNA, 22 nt, Artificial Sequence
  Synthetic
gccguacagagucaaccaauuc

SEQ ID NO: 2181 - RNA, 22 nt, Artificial Sequence
  Synthetic
gguguauggcuugcagccaccc

SEQ ID NO: 2182 - RNA, 22 nt, Artificial Sequence
  Synthetic
agucggcaucugcgcagccgua

SEQ ID NO: 2183 - RNA, 22 nt, Artificial Sequence
  Synthetic
cagaugccgacuuuagaggagg

SEQ ID NO: 2184 - RNA, 22 nt, Artificial Sequence
  Synthetic
ccuucgccugcuggaaaagcag

SEQ ID NO: 2185 - RNA, 22 nt, Artificial Sequence
  Synthetic
uuugggcuguaggugagaacua

SEQ ID NO: 2186 - RNA, 20 nt, Artificial Sequence
  Synthetic
gaaggccugcccagcguagc

SEQ ID NO: 2187 - RNA, 20 nt, Artificial Sequence
  Synthetic
gaauaauaagccggguacag

SEQ ID NO: 2188 - RNA, 20 nt, Artificial Sequence
  Synthetic
gaauccggggcccuuuagcg

SEQ ID NO: 2189 - RNA, 20 nt, Artificial Sequence
  Synthetic
gacgacacucucccgacugg

SEQ ID NO: 2190 - RNA, 20 nt, Artificial Sequence
  Synthetic
gagcgcgaaagaaagaggaa

SEQ ID NO: 2191 - RNA, 20 nt, Artificial Sequence
  Synthetic
gcaagcgcucuccuccaguc

SEQ ID NO: 2192 - RNA, 20 nt, Artificial Sequence
  Synthetic
gccgccgcggaauaauaagc

SEQ ID NO: 2193 - RNA, 20 nt, Artificial Sequence
  Synthetic
gcgaaagaaagaggaaaggg

SEQ ID NO: 2194 - RNA, 20 nt, Artificial Sequence
  Synthetic
gcggcuagagaaaaagcagg

SEQ ID NO: 2195 - RNA, 20 nt, Artificial Sequence
  Synthetic
gcuacccgauuggugaaucc

SEQ ID NO: 2196 - RNA, 20 nt, Artificial Sequence
  Synthetic
gcuggcucuuggaaauugag

SEQ ID NO: 2197 - RNA, 20 nt, Artificial Sequence
  Synthetic
gcugggcaggccuucccggg

SEQ ID NO: 2198 - RNA, 20 nt, Artificial Sequence
  Synthetic
ggcuacccgauuggugaauc

SEQ ID NO: 2199 - RNA, 20 nt, Artificial Sequence
  Synthetic
ggcuagagcgcgaaagaaag

SEQ ID NO: 2200 - RNA, 20 nt, Artificial Sequence
  Synthetic
gggccccggauucaccaauc

SEQ ID NO: 2201 - RNA, 20 nt, Artificial Sequence
  Synthetic
ggggucagggucgugucuag

SEQ ID NO: 2202 - RNA, 20 nt, Artificial Sequence
  Synthetic
ggguacaguggcugggguca

SEQ ID NO: 2203 - RNA, 20 nt, Artificial Sequence
  Synthetic
gguuguuguagcugccgcug

SEQ ID NO: 2204 - RNA, 20 nt, Artificial Sequence
  Synthetic
guacccggcuuauuauuccg

SEQ ID NO: 2205 - RNA, 20 nt, Artificial Sequence
  Synthetic
guccuacuguuucuagucag

SEQ ID NO: 2206 - RNA, 20 nt, Artificial Sequence
  Synthetic
aaauugagcggagagcgacg

SEQ ID NO: 2207 - RNA, 20 nt, Artificial Sequence
  Synthetic
aagucuacgggcuacccgau

SEQ ID NO: 2208 - RNA, 20 nt, Artificial Sequence
  Synthetic
aguuugaaacugcucgcacu

SEQ ID NO: 2209 - RNA, 20 nt, Artificial Sequence
  Synthetic
caaucagagcccagcuacgc

SEQ ID NO: 2210 - RNA, 20 nt, Artificial Sequence
  Synthetic
cccggcuuauuauuccgcgg

SEQ ID NO: 2211 - RNA, 20 nt, Artificial Sequence
  Synthetic
ccgccgcggaauaauaagcc

SEQ ID NO: 2212 - RNA, 20 nt, Artificial Sequence
  Synthetic
cgcaagcgcucuccuccagu

SEQ ID NO: 2213 - RNA, 20 nt, Artificial Sequence
  Synthetic
cgcgcucuagccacccggga

SEQ ID NO: 2214 - RNA, 20 nt, Artificial Sequence
  Synthetic
cgcuugcgcucgcacucagu

SEQ ID NO: 2215 - RNA, 20 nt, Artificial Sequence
  Synthetic
cuacccgauuggugaauccg

SEQ ID NO: 2216 - RNA, 20 nt, Artificial Sequence
  Synthetic
cuacgcugggcaggccuucc

SEQ ID NO: 2217 - RNA, 20 nt, Artificial Sequence
  Synthetic
cucaccgcgcuaaagggccc

SEQ ID NO: 2218 - RNA, 20 nt, Artificial Sequence
  Synthetic
cuccgcugacuagaaacagu

SEQ ID NO: 2219 - RNA, 20 nt, Artificial Sequence
  Synthetic
cuuucgcgcucuagccaccc

SEQ ID NO: 2220 - RNA, 20 nt, Artificial Sequence
  Synthetic
uaggacgacacucucccgac

SEQ ID NO: 2221 - RNA, 20 nt, Artificial Sequence
  Synthetic
ucuuucgcgcucuagccacc

SEQ ID NO: 2222 - RNA, 20 nt, Artificial Sequence
  Synthetic
uggggucagggucgugucua

SEQ ID NO: 2223 - RNA, 20 nt, Artificial Sequence
  Synthetic
uuauuccgcggcggccgcag

SEQ ID NO: 2224 - RNA, 20 nt, Artificial Sequence
  Synthetic
uucaaacucaccgcgcuaaa

SEQ ID NO: 2225 - RNA, 20 nt, Artificial Sequence
  Synthetic
uuucaaacucaccgcgcuaa

SEQ ID NO: 2226 - RNA, 22 nt, Artificial Sequence
  Synthetic
gaauccggggcccuuuagcgcg

SEQ ID NO: 2227 - RNA, 22 nt, Artificial Sequence
  Synthetic
gcaagcgcucuccuccagucgg

SEQ ID NO: 2228 - RNA, 22 nt, Artificial Sequence
  Synthetic
gcggccgccgcggaauaauaag

SEQ ID NO: 2229 - RNA, 22 nt, Artificial Sequence
  Synthetic
guagcugccgcugcggccgccg

SEQ ID NO: 2230 - RNA, 22 nt, Artificial Sequence
  Synthetic
aaacucaccgcgcuaaagggcc

SEQ ID NO: 2231 - RNA, 22 nt, Artificial Sequence
  Synthetic
aaagcaggagggcgggcgccaa

SEQ ID NO: 2232 - RNA, 22 nt, Artificial Sequence
  Synthetic
aagucuacgggcuacccgauug

SEQ ID NO: 2233 - RNA, 22 nt, Artificial Sequence
  Synthetic
agccggguacaguggcuggggu

SEQ ID NO: 2234 - RNA, 22 nt, Artificial Sequence
  Synthetic
auaauaagccggguacaguggc

SEQ ID NO: 2235 - RNA, 22 nt, Artificial Sequence
  Synthetic
cagcuacgcugggcaggccuuc

SEQ ID NO: 2236 - RNA, 22 nt, Artificial Sequence
  Synthetic
uaaagggccccggauucaccaa

SEQ ID NO: 2237 - protein, 1086 aa, Homo sapiens
MAGNHRLGLEAGDTDDPPRITQNPVINGNVALSDGHNTAEEDMEDDTSWRSEATFQFTVERFSRLSESVLSPPCFVRNLPWKIMVMPRFYPDRPHQKSVGFFLQCNAESDSTSWSCHAQAVLKIINYRDDEKSFSRRISHLFFHKENDWGFSNFMAWSEVTDPEKGFIDDDKVTFEVFVQADAPHGVAWDSKKHTGYVGLKNQGATCYMNSLLQTLFFTNQLRKAVYMMPTEGDDSSKSVPLALQRVFYELQHSDKPVGTKKLTKSFGWETLDSFMQHDVQELCRVLLDNVENKMKGTCVEGTIPKLFRGKMVSYIQCKEVDYRSDRREDYYDIQLSIKGKKNIFESFVDYVAVEQLDGDNKYDAGEHGLQEAEKGVKFLTLPPVLHLQLMRFMYDPQTDQNIKINDRFEFPEQLPLDEFLQKTDPKDPANYILHAVLVHSGDNHGGHYVVYLNPKGDGKWCKFDDDVVSRCTKEEAIEHNYGGHDDDLSVRHCTNAYMLVYIRESKLSEVLQAVTDHDIPQQLVERLQEEKRIEAQKRKERQEAHLYMQVQIVAEDQFCGHQGNDMYDEEKVKYTVFKVLKNSSLAEFVQSLSQTMGFPQDQIRLWPMQARSNGTKRPAMLDNEADGNKTMIELSDNENPWTIFLETVDPELAASGATLPKFDKDHDVMLFLKMYDPKTRSLNYCGHIYTPISCKIRDLLPVMCDRAGFIQDTSLILYEEVKPNLTERIQDYDVSLDKALDELMDGDIIVFQKDDPENDNSELPTAKEYFRDLYHRVDVIFCDKTIPNDPGFVVTLSNRMNYFQVAKTVAQRLNTDPMLLQFFKSQGYRDGPGNPLRHNYEGTLRDLLQFFKPRQPKKLYYQQLKMKITDFENRRSFKCIWLNSQFREEEITLYPDKHGCVRDLLEECKKAVELGEKASGKLRLLEIVSYKIIGVHQEDELLECLSPATSRTFRIEEIPLDQVDIDKENEMLVTVAHFHKEVFGTFGIPFLLRIHQGEHFREVMKRIQSLLDIQEKEFEKFKFAIVMMGRHQYINEDEYEVNLKDFEPQPGNMSHPRPWLGLDHFNKAPKRSRYTYLEKAIKIHN

SEQ ID NO: 2238 - protein, 172 aa, Homo sapiens
MASNFKKANMASSSQRKRMSPKPELTEEQKQEIREAFDLFDADGTGTIDVKELKVAMRALGFEPKKEEIKKMISEIDKEGTGKMNFGDFLTVMTQKMSEKDTKEEILKAFKLFDDDETGKISFKNLKRVAKELGENLTDEELQEMIDEADRDGDGEVSEQEFLRIMKKTSLY

SEQ ID NO: 2239 - protein, 409 aa, Homo sapiens
MQVTLKTLQQQTFKIDIDPEETVKALKEKIESEKGKDAFPVAGQKLIYAGKILNDDTALKEYKIDEKNFVVVMVTKPKAVSTPAPATTQQSAPASTTAVTSSTTTTVAQAPTPVPALAPTSTPASITPASATASSEPAPASAAKQEKPAEKPAETPVATSPTATDSTSGDSSRSNLFEDATSALVTGQSYENMVTEIMSMGYEREQVIAALRASFNNPDRAVEYLLMGIPGDRESQAVVDPPQAASTGAPQSSAVAAAAATTTATTTTTSSGGHPLEFLRNQPQFQQMRQIIQQNPSLLPALLQQIGRENPQLLQQISQHQEHFIQMLNEPVQEAGGQGGGGGGGSGGIAEAGSGHMNYIQVTPQEKEAIERLKALGFPEGLVIQAYFACEKNENLAANFLLQQNFDED

SEQ ID NO: 2240 - protein, 337 aa, Homo sapiens
MVTKPKAVSTPAPATTQQSAPASTTAVTSSTTTTVAQAPTPVPALAPTSTPASITPASATASSEPAPASAAKQEKPAEKPAETPVATSPTATDSTSGDSSRSNLFEDATSALVTGQSYENMVTEIMSMGYEREQVIAALRASFNNPDRAVEYLLMGIPGDRESQAVVDPPQAASTGAPQSSAVAAAAATTTATTTTTSSGGHPLEFLRNQPQFQQMRQIIQQNPSLLPALLQQIGRENPQLLQQISQHQEHFIQMLNEPVQEAGGQGGGGGGGSGGIAEAGSGHMNYIQVTPQEKEAIERLKALGFPEGLVIQAYFACEKNENLAANFLLQQNFDED

SEQ ID NO: 2241 - protein, 427 aa, Homo sapiens
MAPKKRPETQKTSEIVLRPRNKRSRSPLELEPEAKKLCAKGSGPSRRCDSDCLWVGLAGPQILPPCRSIVRTLHQHKLGRASWPSVQQGLQQSFLHTLDSYRILQKAAPFDRRATSLAWHPTHPSTVAVGSKGGDIMLWNFGIKDKPTFIKGIGAGGSITGLKFNPLNTNQFYASSMEGTTRLQDFKGNILRVFASSDTINIWFCSLDVSASSRMVVTGDNVGNVILLNMDGKELWNLRMHKKKVTHVALNPCCDWFLATASVDQTVKIWDLRQVRGKASFLYSLPHRHPVNAACFSPDGARLLTTDQKSEIRVYSASQWDCPLGLIPHPHRHFQHLTPIKAAWHPRYNLIVVGRYPDPNFKSCTPYELRTIDVFDGNSGKMMCQLYDPESSGISSLNEFNPMGDTLASAMGYHILIWSQEEARTRK

SEQ ID NO: 2242 - protein, 238 aa, Homo sapiens
MAPKKRPETQKTSEIVLRPRNKRSRSPLELEPEAKKLCAKGSGPSRRCDSDCLWVGLAGPQILPPCRSIVRTLHQHKLGRASWPSVQQGLQQSFLHTLDSYRILQKAAPFDRRATSLAWHPTHPSTVAVGSKGGDIMLWNFGIKDKPTFIKGAAWHPRYNLIVVGRYPDPNFKSCTPYELRTIDVFDGNSGKMMCQLYDPESSGISSLNEFNPMGDTLASAMGYHILIWSQEEARTRK

SEQ ID NO: 2243 - protein, 156 aa, Homo sapiens
MAPKKRPETQKTSEIVLRPRNKRSRSPLELEPEAKKLCAKGSGPSRRCDSDCLWVGLAGPQILPPCRSIVRTLHQHKLGRASWPSVQQGLQQSFLHTLDSYRILQKAAPFDRRATSLAWHPTHPSTVAVGSKGGDIMLWNFGIKDKPTFIKGHLVL

SEQ ID NO: 2244 - protein, 363 aa, Homo sapiens
MAPKKRPETQKTSEIVLRPRNKRSRSPLELEPEAKKLCAKGSGPSRRCDSDCLWVGLAGPQILPPCRSIVRTLHQHKLGRASWPSVQQIGAGGSITGLKFNPLNTNQFYASSMEGTTRLQDFKGNILRVFASSDTINIWFCSLDVSASSRMVVTGDNVGNVILLNMDGKELWNLRMHKKKVTHVALNPCCDWFLATASVDQTVKIWDLRQVRGKASFLYSLPHRHPVNAACFSPDGARLLTTDQKSEIRVYSASQWDCPLGLIPHPHRHFQHLTPIKAAWHPRYNLIVVGRYPDPNFKSCTPYELRTIDVFDGNSGKMMCQLYDPESSGISSLNEFNPMGDTLASAMGYHILIWSQEEARTRK

SEQ ID NO: 2245 - protein, 244 aa, Homo sapiens
MAPKKRPETQKTSEIVLRPRNKRSRSPLELEPEAKKLCAKGSGPSRRCDSDCLWVGLAGPQILPPCRSIVRTLHQHKLGRASWPSVQQGLQQSFLHTLDSYRILQKAAPFDRRATSLAWHPTHPSTVAVGSKGGDIMLWNFGIKDKPTFIKGIGAGGSITGLKFNPLNTNQFYASSMEGTTRLQDFKGNILRVFASSDTINIWFCSLDVSASSRMVVTGDNVGNVILLNMDGKELVSVPMEPGS

SEQ ID NO: 2246 - RNA, 19 nt, Artificial Sequence
  Synthetic
cagcgacuguuugagaacc

SEQ ID NO: 2247 - RNA, 19 nt, Artificial Sequence
  Synthetic
cuaaugagcuuccauacaa

SEQ ID NO: 2248 - RNA, 19 nt, Artificial Sequence
  Synthetic
gcggauagcuugugaugaa

SEQ ID NO: 2249 - RNA, 19 nt, Artificial Sequence
  Synthetic
gcaaagaaagcuagaauug

SEQ ID NO: 2250 - protein, 499 aa, Artificial Sequence
  Synthetic
MGEEEFDMPQPPHGHVLHRHMRTIREVRTLVTRVITDVYYVDGTEVERKVTEETEEPIVECQECETEVSPSQTGGSSGDLGDISSFSSKASSLHRTSSGTSLSAMHSSGSSGKGAGPLRGKTSGTEPADFALPSSRGGPGKLSPRKGVSQTGTPVCEEDGDAGLGIRQGGKAPVTPRGRGRRGRPPSRTTGTRETAVPGPLGIEDISPNLSPDDKSFSRVVPRVPDSTRRTDVGAGALRRSDSPEIPFQAAAGPSDGLDASSPGNSFVGLRVVAKWSSNGYFYSGKITRDVGAGKYKLLFDDGYECDVLGKDILLCDPIPLDTEVTALSEDEYFSAGVVKGHRKESGELYYSIEKEGQRKWYKRMAVILSLEQGNRLREQYGLGPYEAVTPLTKAADISLDNLVEGKRKRRSNVSSPATPTASSSSSTTPTRKITESPRASMGVLSGKRKLITSEEERSPAKRGRKSATVKPGAVGAGEFVSPCESGDNTGEPSALEEQ

SEQ ID NO: 2251 - DNA, 1500 bp, Artificial Sequence
  Synthetic
atgggagaagaagagtttgatatgcctcagcctccacatggccatgtcttacatcgtcacatgagaacaatccgggaagtacgcacacttgtcactcgtgtcattacagatgtgtattatgtggatggaacagaagtagaaagaaaagtaactgaggagactgaagagccaattgtagagtgtcaggagtgtgaaactgaagtttccccttcacagactgggggctcctcaggtgacctgggggatatcagctccttctcctccaaggcatccagcttacaccgcacatcaagtgggacaagtctctcagctatgcacagcagtggaagctcagggaaaggagccggaccactcagagggaaaaccagcgggacagaacccgcagattttgccttacccagctcccgaggaggcccaggaaaactgagtcctagaaaaggggtcagtcagacagggacgccagtgtgtgaggaggatggtgatgcaggccttggcatcagacagggagggaaggctccagtcacgcctcgtgggcgtgggcgaaggggccgcccaccttctcggaccactggaaccagagaaacagctgtgcctggccccttgggcatagaggacatttcacctaacttgtcaccagatgataaatccttcagccgtgtcgtgccccgagtgccagactccaccagacgaacagatgtgggtgctggtgctttgcgtcgtagtgactctccagaaattcctttccaggctgctgctggcccttctgatggcttagatgcctcctctccaggaaatagctttgtagggctccgtgttgtagccaagtggtcatccaatggctacttttactctgggaaaatcacacgagatgtcggagctgggaagtataaattgctctttgatgatgggtacgaatgtgatgtgttgggcaaagacattctgttatgtgaccccatcccgctggacactgaagtgacggccctctcggaggatgagtatttcagtgcaggagtggtgaaaggacataggaaggagtctggggaactgtactacagcattgaaaaagaaggccaaagaaagtggtataagcgaatggctgtcatcctgtccttggagcaaggaaacagactgagagagcagtatgggcttggcccctatgaagcagtaacacctcttacaaaggcagcagatatcagcttagacaatttggtggaagggaagcggaaacggcgcagtaacgtcagctccccagccacccctactgcctccagtagcagcagcacaacccctacccgaaagatcacagaaagtcctcgtgcctccatgggagttctctcaggcaaaagaaaacttatcacttctgaagaggaacggtcccctgccaagcgaggtcgcaagtctgccacagtaaaacctggtgcagtaggggcaggagagtttgtgagcccctgtgagagtggagacaacaccggtgaaccctctgccctggaagagcagtaa

SEQ ID NO: 2252 - protein, 660 aa, Artificial Sequence
  Synthetic
MDPPTTPIRGNLLHFPSSQGEEEKEKLEGDHTIRQSQQPMKPISPVKDPVSPASQKMVIQGPSSPQGEAMVTDVLEDQKEGRSTNKENPSKALIERPSQNNIGIQTMECSLRVPETVSAATQTIKNVCEQGTSTVDQNFGKQDATVQTERGSGEKPVSAPGDDTESLHSQGEEEFDMPQPPHGHVLHRHMRTIREVRTLVTRVITDVYYVDGTEVERKVTEETEEPIVECQECETEVSPSQTGGSSGDLGDISSFSSKASSLHRTSSGTSLSAMHSSGSSGKGAGPLRGKTSGTEPADFALPSSRGGPGKLSPRKGVSQTGTPVCEEDGDAGLGIRQGGKAPVTPRGRGRRGRPPSRTTGTRETAVPGPLGIEDISPNLSPDDKSFSRVVPRVPDSTRRTDVGAGALRRSDSPEIPFQAAAGPSDGLDASSPGNSFVGLRVVAKWSSNGYFYSGKITRDVGAGKYKLLFDDGYECDVLGKDILLCDPIPLDTEVTALSEDEYFSAGVVKGHRKESGELYYSIEKEGQRKWYKRMAVILSLEQGNRLREQYGLGPYEAVTPLTKAADISLDNLVEGKRKRRSNVSSPATPTASSSSSTTPTRKITESPRASMGVLSGKRKLITSEEERSPAKRGRKSATVKPGAVGAGEFVSPCESGDNTG

SEQ ID NO: 2253 - DNA, 1983 bp, Artificial Sequence
  Synthetic
atggatccccccaccacacccatcagggggaacttgctccactttccaagttctcaaggagaagaggagaaagaaaaattggagggtgaccatacaatcaggcagagtcaacagcctatgaagcccattagtcctgtcaaggaccctgtttctcctgcttcccagaagatggtcatacaagggccatccagtcctcaaggagaggcaatggtgacagatgtgctagaagaccagaaagaaggacggagtactaataaggaaaatcctagtaaggccttgattgaaaggcccagccaaaataacataggaatccaaaccatggagtgttccttgagggtcccagaaactgtttcagcagcaacccagactataaagaatgtgtgtgagcaggggaccagtacagtggaccagaactttggaaagcaagatgccacagttcagactgagagggggagtggtgagaaaccagtcagtgctcctggggatgatacagagtcgctccatagccagggagaagaagagtttgatatgcctcagcctccacatggccatgtcttacatcgtcacatgagaacaatccgggaagtacgcacacttgtcactcgtgtcattacagatgtgtattatgtggatggaacagaagtagaaagaaaagtaactgaggagactgaagagccaattgtagagtgtcaggagtgtgaaactgaagtttccccttcacagactgggggctcctcaggtgacctgggggatatcagctccttctcctccaaggcatccagcttacaccgcacatcaagtgggacaagtctctcagctatgcacagcagtggaagctcagggaaaggagccggaccactcagagggaaaaccagcgggacagaacccgcagattttgccttacccagctcccgaggaggcccaggaaaactgagtcctagaaaaggggtcagtcagacagggacgccagtgtgtgaggaggatggtgatgcaggccttggcatcagacagggagggaaggctccagtcacgcctcgtgggcgtgggcgaaggggccgcccaccttctcggaccactggaaccagagaaacagctgtgcctggccccttgggcatagaggacatttcacctaacttgtcaccagatgataaatccttcagccgtgtcgtgccccgagtgccagactccaccagacgaacagatgtgggtgctggtgctttgcgtcgtagtgactctccagaaattcctttccaggctgctgctggcccttctgatggcttagatgcctcctctccaggaaatagctttgtagggctccgtgttgtagccaagtggtcatccaatggctacttttactctgggaaaatcacacgagatgtcggagctgggaagtataaattgctctttgatgatgggtacgaatgtgatgtgttgggcaaagacattctgttatgtgaccccatcccgctggacactgaagtgacggccctctcggaggatgagtatttcagtgcaggagtggtgaaaggacataggaaggagtctggggaactgtactacagcattgaaaaagaaggccaaagaaagtggtataagcgaatggctgtcatcctgtccttggagcaaggaaacagactgagagagcagtatgggcttggcccctatgaagcagtaacacctcttacaaaggcagcagatatcagcttagacaatttggtggaagggaagcggaaacggcgcagtaacgtcagctccccagccacccctactgcctccagtagcagcagcacaacccctacccgaaagatcacagaaagtcctcgtgcctccatgggagttctctcaggcaaaagaaaacttatcacttctgaagaggaacggtcccctgccaagcgaggtcgcaagtctgccacagtaaaacctggtgcagtaggggcaggagagtttgtgagcccctgtgagagtggagacaacaccggttaa

SEQ ID NO: 2254 - RNA, 21 nt, Artificial Sequence
  Synthetic
cguacgcggaauacuucgauu

SEQ ID NO: 2255 - DNA, 21 bp, Artificial Sequence
  Synthetic
ggagtgggaaacggcggcgtt

SEQ ID NO: 2256 - DNA, 21 bp, Artificial Sequence
  Synthetic
gtgccagcccccagttcctct

SEQ ID NO: 2257 - DNA, 22 bp, Artificial Sequence
  Synthetic
gtgtcaccgccgcttcccgaga

SEQ ID NO: 2258 - DNA, 21 bp, Artificial Sequence
  Synthetic
aggatggctgtcacgtcctcc

SEQ ID NO: 2259 - DNA, 21 bp, Artificial Sequence
  Synthetic
acactgagccgccgccagcag

SEQ ID NO: 2260 - DNA, 21 bp, Artificial Sequence
  Synthetic
tgtggttccttcatgccggga

SEQ ID NO: 2261 - DNA, 21 bp, Artificial Sequence
  Synthetic
gccgggaaagaatgaggtgaa

SEQ ID NO: 2262 - DNA, 21 bp, Artificial Sequence
  Synthetic
acataagtagccgcatggctg

SEQ ID NO: 2263 - DNA, 21 bp, Artificial Sequence
  Synthetic
ccctgaggcagaggctgggcc

SEQ ID NO: 2264 - DNA, 21 bp, Artificial Sequence
  Synthetic
cagcctctgcctcagggcctt

SEQ ID NO: 2265 - DNA, 21 bp, Artificial Sequence
  Synthetic
tgcagtgccagtacacagcag

SEQ ID NO: 2266 - DNA, 21 bp, Artificial Sequence
  Synthetic
aatttggcaccatggggatac

SEQ ID NO: 2267 - DNA, 21 bp, Artificial Sequence
  Synthetic
cctttatacttcctcacatgg

SEQ ID NO: 2268 - DNA, 21 bp, Artificial Sequence
  Synthetic
cgaagcggtctatggagatag

SEQ ID NO: 2269 - DNA, 21 bp, Artificial Sequence
  Synthetic
tcctgtcccactgccacaaag

SEQ ID NO: 2270 - DNA, 21 bp, Artificial Sequence
  Synthetic
tagttgcaacagatattcatc

SEQ ID NO: 2271 - DNA, 21 bp, Artificial Sequence
  Synthetic
tgggcaagtcttaaaatttca

SEQ ID NO: 2272 - DNA, 21 bp, Artificial Sequence
  Synthetic
atctttctccataaatccaag

SEQ ID NO: 2273 - DNA, 21 bp, Artificial Sequence
  Synthetic
ggagggacctcatcctcgtcg

SEQ ID NO: 2274 - DNA, 21 bp, Artificial Sequence
  Synthetic
gcaccccctctttgtccttcc

SEQ ID NO: 2275 - DNA, 21 bp, Artificial Sequence
  Synthetic
aagagggggtgccccagccct

SEQ ID NO: 2276 - DNA, 21 bp, Artificial Sequence
  Synthetic
aaatttgtgatacccctcgac

SEQ ID NO: 2277 - DNA, 21 bp, Artificial Sequence
  Synthetic
cgacgaggatgaggtccctcc

SEQ ID NO: 2278 - DNA, 22 bp, Artificial Sequence
  Synthetic
gtaaagtcactagatgtatctg

SEQ ID NO: 2279 - DNA, 22 bp, Artificial Sequence
  Synthetic
gaggacctttggacaaaactaa

SEQ ID NO: 2280 - RNA, 20 nt, Artificial Sequence
  Synthetic
guaacggcagacuucuccuc

SEQ ID NO: 2281 - RNA, 20 nt, Artificial Sequence
  Synthetic
aaggugaacguggaugaagu

SEQ ID NO: 2282 - protein, 746 aa, Homo sapiens
MGQTGKKSEKGPVCWRKRVKSEYMRLRQLKRFRRADEVKSMFSSNRQKILERTEILNQEWKQRRIQPVHILTSVSSLRGTRECSVTSDLDFPTQVIPLKTLNAVASVPIMYSWSPLQQNFMVEDETVLHNIPYMGDEVLDQDGTFIEELIKNYDGKVHGDRECGFINDEIFVELVNALGQYNDDDDDDDGDDPEEREEKQKDLEDHRDDKESRPPRKFPSDKIFEAISSMFPDKGTAEELKEKYKELTEQQLPGALPPECTPNIDGPNAKSVQREQSLHSFHTLFCRRCFKYDCFLHPFHATPNTYKRKNTETALDNKPCGPQCYQHLEGAKEFAAALTAERIKTPPKRPGGRRRGRLPNNSSRPSTPTINVLESKDTDSDREAGTETGGENNDKEEEEKKDETSSSSEANSRCQTPIKMKPNIEPPENVEWSGAEASMFRVLIGTYYDNFCAIARLIGTKTCRQVYEFRVKESSIIAPAPAEDVDTPPRKKKRKHRLWAAHCRKIQLKKDGSSNHVYNYQPCDHPRQPCDSSCPCVIAQNFCEKFCQCSSECQNRFPGCRCKAQCNTKQCPCYLAVRECDPDLCLTCGAADHWDSKNVSCKNCSIQRGSKKHLLLAPSDVAGWGIFIKDPVQKNEFISEYCGEIISQDEADRRGKVYDKYMCSFLFNLNNDFVVDATRKGNKIRFANHSVNPNCYAKVMMVNGDHRIGIFAKRAIQTGEELFFDYRYSQADALKYVGIEREMEIP

SEQ ID NO: 2283 - protein, 751 aa, Homo sapiens
MGQTGKKSEKGPVCWRKRVKSEYMRLRQLKRFRRADEVKSMFSSNRQKILERTEILNQEWKQRRIQPVHILTSVSSLRGTRECSVTSDLDFPTQVIPLKTLNAVASVPIMYSWSPLQQNFMVEDETVLHNIPYMGDEVLDQDGTFIEELIKNYDGKVHGDRECGFINDEIFVELVNALGQYNDDDDDDDGDDPEEREEKQKDLEDHRDDKESRPPRKFPSDKIFEAISSMFPDKGTAEELKEKYKELTEQQLPGALPPECTPNIDGPNAKSVQREQSLHSFHTLFCRRCFKYDCFLHRKCNYSFHATPNTYKRKNTETALDNKPCGPQCYQHLEGAKEFAAALTAERIKTPPKRPGGRRRGRLPNNSSRPSTPTINVLESKDTDSDREAGTETGGENNDKEEEEKKDETSSSSEANSRCQTPIKMKPNIEPPENVEWSGAEASMFRVLIGTYYDNFCAIARLIGTKTCRQVYEFRVKESSIIAPAPAEDVDTPPRKKKRKHRLWAAHCRKIQLKKDGSSNHVYNYQPCDHPRQPCDSSCPCVIAQNFCEKFCQCSSECQNRFPGCRCKAQCNTKQCPCYLAVRECDPDLCLTCGAADHWDSKNVSCKNCSIQRGSKKHLLLAPSDVAGWGIFIKDPVQKNEFISEYCGEIISQDEADRRGKVYDKYMCSFLFNLNNDFVVDATRKGNKIRFANHSVNPNCYAKVMMVNGDHRIGIFAKRAIQTGEELFFDYRYSQADALKYVGIEREMEIP

SEQ ID NO: 2284 - protein, 707 aa, Homo sapiens
MGQTGKKSEKGPVCWRKRVKSEYMRLRQLKRFRRADEVKSMFSSNRQKILERTEILNQEWKQRRIQPVHILTSVSSLRGTREVEDETVLHNIPYMGDEVLDQDGTFIEELIKNYDGKVHGDRECGFINDEIFVELVNALGQYNDDDDDDDGDDPEEREEKQKDLEDHRDDKESRPPRKFPSDKIFEAISSMFPDKGTAEELKEKYKELTEQQLPGALPPECTPNIDGPNAKSVQREQSLHSFHTLFCRRCFKYDCFLHPFHATPNTYKRKNTETALDNKPCGPQCYQHLEGAKEFAAALTAERIKTPPKRPGGRRRGRLPNNSSRPSTPTINVLESKDTDSDREAGTETGGENNDKEEEEKKDETSSSSEANSRCQTPIKMKPNIEPPENVEWSGAEASMFRVLIGTYYDNFCAIARLIGTKTCRQVYEFRVKESSIIAPAPAEDVDTPPRKKKRKHRLWAAHCRKIQLKKDGSSNHVYNYQPCDHPRQPCDSSCPCVIAQNFCEKFCQCSSECQNRFPGCRCKAQCNTKQCPCYLAVRECDPDLCLTCGAADHWDSKNVSCKNCSIQRGSKKHLLLAPSDVAGWGIFIKDPVQKNEFISEYCGEIISQDEADRRGKVYDKYMCSFLFNLNNDFVVDATRKGNKIRFANHSVNPNCYAKVMMVNGDHRIGIFAKRAIQTGEELFFDYRYSQADALKYVGIEREMEIP

SEQ ID NO: 2285 - protein, 482 aa, Homo sapiens
MAQTQGTRRKVCYYYDGDVGNYYYGQGHPMKPHRIRMTHNLLLNYGLYRKMEIYRPHKANAEEMTKYHSDDYIKFLRSIRPDNMSEYSKQMQRFNVGEDCPVFDGLFEFCQLSTGGSVASAVKLNKQQTDIAVNWAGGLHHAKKSEASGFCYVNDIVLAILELLKYHQRVLYIDIDIHHGDGVEEAFYTTDRVMTVSFHKYGEYFPGTGDLRDIGAGKGKYYAVNYPLRDGIDDESYEAIFKPVMSKVMEMFQPSAVVLQCGSDSLSGDRLGCFNLTIKGHAKCVEFVKSFNLPMLMLGGGGYTIRNVARCWTYETAVALDTEIPNELPYNDYFEYFGPDFKLHISPSNMTNQNTNEYLEKIKQRLFENLRMLPHAPGVQMQAIPEDAIPEESGDEDEDDPDKRISICSSDKRIACEEEFSDSEEEGEGGRKNSSNFKKAKRVKTEDEKEKDPEEKKEVTEEEKTKEEKPEAKGVKEEVKLA

SEQ ID NO: 2286 - protein, 488 aa, Homo sapiens
MAYSQGGGKKKVCYYYDGDIGNYYYGQGHPMKPHRIRMTHNLLLNYGLYRKMEIYRPHKATAEEMTKYHSDEYIKFLRSIRPDNMSEYSKQMQRFNVGEDCPVFDGLFEFCQLSTGGSVAGAVKLNRQQTDMAVNWAGGLHHAKKSEASGFCYVNDIVLAILELLKYHQRVLYIDIDIHHGDGVEEAFYTTDRVMTVSFHKYGEYFPGTGDLRDIGAGKGKYYAVNFPMRDGIDDESYGQIFKPIISKVMEMYQPSAVVLQCGADSLSGDRLGCFNLTVKGHAKCVEVVKTFNLPLLMLGGGGYTIRNVARCWTYETAVALDCEIPNELPYNDYFEYFGPDFKLHISPSNMTNQNTPEYMEKIKQRLFENLRMLPHAPGVQMQAIPEDAVHEDSGDEDGEDPDKRISIRASDKRIACDEEFSDSEDEGEGGRRNVADHKKGAKKARIEEDKKETEDKKTDVKEEDKSKDNSGEKTDTKGTKSEQLSNP

SEQ ID NO: 2287 - protein, 1064 aa, Homo sapiens
MASESETLNPSARIMTFYPTMEEFRNFSRYIAYIESQGAHRAGLAKVVPPKEWKPRASYDDIDDLVIPAPIQQLVTGQSGLFTQYNIQKKAMTVREFRKIANSDKYCTPRYSEFEELERKYWKNLTFNPPIYGADVNGTLYEKHVDEWNIGRLRTILDLVEKESGITIEGVNTPYLYFGMWKTSFAWHTEDMDLYSINYLHFGEPKSWYSVPPEHGKRLERLAKGFFPGSAQSCEAFLRHKMTLISPLMLKKYGIPFDKVTQEAGEFMITFPYGYHAGFNHGFNCAESTNFATRRWIEYGKQAVLCSCRKDMVKISMDVFVRKFQPERYKLWKAGKDNTVIDHTLPTPEAAEFLKESELPPRAGNEEECPEEDMEGVEDGEEGDLKTSLAKHRIGTKRHRVCLEIPQEVSQSELFPKEDLSSEQYEMTECPAALAPVRPTHSSVRQVEDGLTFPDYSDSTEVKFEELKNVKLEEEDEEEEQAAAALDLSVNPASVGGRLVFSGSKKKSSSSLGSGSSRDSISSDSETSEPLSCRAQGQTGVLTVHSYAKGDGRVTVGEPCTRKKGSAARSFSERELAEVADEYMFSLEENKKSKGRRQPLSKLPRHHPLVLQECVSDDETSEQLTPEEEAEETEAWAKPLSQLWQNRPPNFEAEKEFNETMAQQAPHCAVCMIFQTYHQVEFGGFNQNCGNASDLAPQKQRTKPLIPEMCFTSTGCSTDINLSTPYLEEDGTSILVSCKKCSVRVHASCYGVPPAKASEDWMCSRCSANALEEDCCLCSLRGGALQRANDDRWVHVSCAVAILEARFVNIAERSPVDVSKIPLPRFKLKCIFCKKRRKRTAGCCVQCSHGRCPTAFHVSCAQAAGVMMQPDDWPFVVFITCFRHKIPNLERAKGALQSITAGQKVISKHKNGRFYQCEVVRLTTETFYEVNFDDGSFSDNLYPEDIVSQDCLQFGPPAEGEVVQVRWTDGQVYGAKFVASHPIQMYQVEFEDGSQLVVKRDDVYTLDEELPKRVKSRLSVASDMRFNEIFTEKEVKQEKKRQRVINSRYREDYIEPALYRAIME

SEQ ID NO: 2288 - protein, 481 aa, Homo sapiens
MFSLEENKKSKGRRQPLSKLPRHHPLVLQECVSDDETSEQLTPEEEAEETEAWAKPLSQLWQNRPPNFEAEKEFNETMAQQAPHCAVCMIFQTYHQVEFGGFNQNCGNASDLAPQKQRTKPLIPEMCFTSTGCSTDINLSTPYLEEDGTSILVSCKKCSVRVHASCYGVPPAKASEDWMCSRCSANALEEDCCLCSLRGGALQRANDDRWVHVSCAVAILEARFVNIAERSPVDVSKIPLPRFKLKCIFCKKRRKRTAGCCVQCSHGRCPTAFHVSCAQAAGVMMQPDDWPFVVFITCFRHKIPNLERAKGALQSITAGQKVISKHKNGRFYQCEVVRLTTETFYEVNFDDGSFSDNLYPEDIVSQDCLQFGPPAEGEVVQVRWTDGQVYGAKFVASHPIQMYQVEFEDGSQLVVKRDDVYTLDEELPKRVKSRLSVASDMRFNEIFTEKEVKQEKKRQRVINSRYREDYIEPALYRAIME

What is claimed is:

1. A method of altering a sequence of a target nucleic acid in a cell comprising contacting the cell with:
   a Cas9 system comprising
   a homology directed repair (HDR) enhancer molecule, wherein the enhancer molecule is an inhibitor of one or more of CDK1, 53BP1, Rif1, PtIP, Fbh1, RTEL, PARI, Rap80, Ligase I, Polymerase theta, Rad52, ERCC1, XPF, CtiP or Exo 1; a dominant negative form of 53BP1; Resveratrol; Trichostatin A; or a modulator of KDM4A, Setd2, HDAC1, HDAC2, or EZH2,
   a Cas9 molecule, and
   a gRNA molecule, wherein the gRNA molecule is capable of targeting the Cas9 molecule to a target nucleic acid,
   under conditions that allow for alteration of the sequence of the target nucleic acid of the cell, thereby altering the sequence of the target nucleic acid of the cell.

2. A method of treating a subject by altering a sequence of a target nucleic acid in a cell in the subject, comprising contacting the cell with:
   a Cas9 system comprising
   an HDR-enhancer molecule, wherein the enhancer molecule is an inhibitor of one or more of CDK1, 53BP1, Rif1, PtIP, Fbh1, RTEL, PARI, Rap80, Ligase I, Polymerase theta, Rad52, ERCC1, XPF, CtiP or Exo 1; a dominant negative form of 53BP1; Resveratrol; Trichostatin A; or a modulator of KDM4A, Setd2, HDAC1, HDAC2, or EZH2,
   a Cas9 molecule, and
   a gRNA molecule, wherein the gRNA molecule is capable of targeting the Cas9 molecule to a target nucleic acid,
   under conditions that allow for alteration of the sequence of the target nucleic acid, thereby treating the subject by altering the sequence of the target nucleic acid in the cell in the subject.

3. The method of claim 2, wherein the subject has a disorder that is caused by a mutation in the target nucleic acid.

4. The method of claim 1 or claim 2, wherein altering the sequence of the target nucleic acid comprises resection.

5. The method of claim 4, wherein resection occurs at a single strand break or at a double strand break.

6. A method of promoting DNA repair of a break in a nucleic acid in a cell via an HDR pathway, the method comprising contacting the cell with:
   a Cas9 system comprising
   an HDR-enhancer molecule, wherein the enhancer molecule is an inhibitor of one or more of CDK1, 53BP1, Rif1, PtIP, Fbh1, RTEL, PARI, Rap80, Ligase I, Polymerase theta, Rad52, ERCC1, XPF, CtiP or Exo 1; a dominant negative form of 53BP1; Resveratrol; Trichostatin A; or a modulator of KDM4A, Setd2, HDAC1, HDAC2, or EZH2,
   a Cas9 molecule, and
   a gRNA molecule, wherein the gRNA molecule is capable of targeting the Cas9 molecule to a target nucleic acid, under conditions that allow for repair of the break in the nucleic acid in the cell via an HDR pathway.

7. The method of any one of claim 1, 2 and or 6, wherein the inhibitor is an HDR-enhancing gRNA, an siRNA, an miRNA, or an antiMiR.

8. The method of any one of claim 1, 2 and or 6, wherein the Cas9 system further comprises a second gRNA molecule, wherein the second gRNA molecule is capable of targeting the Cas9 molecule to the target nucleic acid.

9. The method of any one of claim 1, 2 and or 6, wherein the HDR-enhancer molecule is capable of increasing the frequency or efficiency of HDR in a cell as compared to what would occur in the absence of the HDR-enhancer molecule.

10. The method of any one of claim 1, 2 and or 6, wherein the Cas9 system further comprises a template nucleic acid.

11. The method of claim 10, wherein the cell is contacted with two or more of the gRNA molecule, the Cas9 molecule, the template nucleic acid, and the HDR-enhancer molecule at the same time.

12. The method of any one of claim 1, 2 and or 6, further comprising contacting the cell with a cell cycle arrest compound.

13. The method of any one of claim 1, 2 and or 6, wherein the sequence of the target nucleic acid is altered via HR-mediated repair, SSA-mediated repair, or alt-HR-mediated repair.

14. The method of any one of claim 1, 2 and or 6, wherein the inhibitor is a peptide, an antibody, or a small molecule.

15. The method of any one of claim 1, 2 and or 6, wherein the enhancer molecule is an inhibitor of CDK1, Polymerase theta, or Exo 1; a dominant negative form of 53BP1; Resveratrol; Trichostatin A; or a modulator of KDM4A, Setd2, HDAC1, HDAC2, or EZH2.

16. An ex vivo method of treating a disease in a subject in need thereof, the method comprising altering a sequence of a target nucleic acid in a cell of the subject by contacting the cell with:
   a Cas9 system comprising
   a homology directed repair (HDR) enhancer molecule, wherein the enhancer molecule is an inhibitor of one or more of CDK1, 53BP1, Rif1, PtIP, Fbh1, RTEL, PARI, Rap80, Ligase I, Polymerase theta, Rad52, ERCC1, XPF, CtiP or Exo 1; a dominant negative form of 53BP1; Resveratrol; Trichostatin A; or a modulator of KDM4A, Setd2, HDAC1, HDAC2, or EZH2,
   a Cas9 molecule, and
   a gRNA molecule, wherein the gRNA molecule is capable of targeting the Cas9 molecule to a target nucleic acid,
   wherein contacting the cell is performed ex vivo and the contacted cell is returned to the subject's body after the contacting step, thereby treating the disease in the subject.

17. The method of claim 16, wherein the subject is a human.

* * * * *